United States Patent
Gourguechon

(10) Patent No.: US 10,787,662 B2
(45) Date of Patent: Sep. 29, 2020

(54) METHODS AND COMPOSITIONS FOR THE MAKING AND USING OF GUIDE NUCLEIC ACIDS

(71) Applicant: Arc Bio, LLC, Cambridge, MA (US)

(72) Inventor: Stephane B. Gourguechon, San Mateo, CA (US)

(73) Assignee: ARC BIO, LLC, Cambridge, MA (US)

( * ) Notice: Subject to any disclaimer, the term of this patent is extended or adjusted under 35 U.S.C. 154(b) by 73 days.

(21) Appl. No.: 15/742,862

(22) PCT Filed: Dec. 7, 2016

(86) PCT No.: PCT/US2016/065420
§ 371 (c)(1),
(2) Date: Jan. 8, 2018

(87) PCT Pub. No.: WO2017/100343
PCT Pub. Date: Jun. 15, 2017

(65) Prior Publication Data
US 2019/0270984 A1 Sep. 5, 2019

Related U.S. Application Data

(60) Provisional application No. 62/298,963, filed on Feb. 23, 2016, provisional application No. 62/264,262, filed on Dec. 7, 2015.

(51) Int. Cl.
| | | |
|---|---|---|
| *C12N 15/00* | (2006.01) |
| *C12N 15/10* | (2006.01) |
| *C12N 9/22* | (2006.01) |
| *C12N 15/113* | (2010.01) |
| *C12N 15/115* | (2010.01) |
| *C12N 15/62* | (2006.01) |
| *C12N 15/63* | (2006.01) |
| *C40B 40/06* | (2006.01) |
| *A61K 48/00* | (2006.01) |
| *C12N 15/11* | (2006.01) |

(52) U.S. Cl.
CPC .......... *C12N 15/1068* (2013.01); *A61K 48/00* (2013.01); *C12N 9/22* (2013.01); *C12N 15/111* (2013.01); *C12N 15/113* (2013.01); *C12N 15/115* (2013.01); *C12N 15/62* (2013.01); *C12N 15/63* (2013.01); *C40B 40/06* (2013.01); *C12N 2310/20* (2017.05); *C12N 2320/10* (2013.01); *C12N 2750/14143* (2013.01); *C12N 2800/70* (2013.01)

(58) Field of Classification Search
None
See application file for complete search history.

(56) References Cited

U.S. PATENT DOCUMENTS

| | | | |
|---|---|---|---|
| 5,948,902 A | 9/1999 | Honkanen et al. |
| 9,102,944 B2 | 8/2015 | Ness et al. |
| 2005/0233340 A1 | 10/2005 | Barrett et al. |
| 2006/0088821 A1 | 4/2006 | Short |
| 2011/0256593 A1 | 10/2011 | Hsieh et al. |
| 2013/0298265 A1 | 11/2013 | Cunnac et al. |
| 2014/0030704 A1 | 1/2014 | Mikawa |
| 2014/0068797 A1 | 3/2014 | Doudna et al. |
| 2014/0087378 A1 | 3/2014 | Chatre et al. |
| 2014/0273226 A1* | 9/2014 | Wu ...................... C12N 15/907 435/455 |
| 2014/0357523 A1 | 12/2014 | Zeiner et al. |
| 2015/0059010 A1 | 2/2015 | Cigan et al. |
| 2015/0094212 A1 | 4/2015 | Gottimukkala et al. |
| 2015/0211002 A1 | 7/2015 | Keefe et al. |
| 2015/0284789 A1 | 10/2015 | Hogers |
| 2016/0053304 A1 | 2/2016 | Wurtzel et al. |
| 2016/0115530 A1 | 4/2016 | Kladde et al. |
| 2016/0208241 A1* | 7/2016 | Tsai ...................... C12Q 1/6806 |
| 2016/0237488 A1 | 8/2016 | Ke et al. |
| 2016/0354752 A1 | 12/2016 | Banyai et al. |
| 2016/0362680 A1 | 12/2016 | Armour et al. |
| 2017/0121694 A1 | 5/2017 | May et al. |

FOREIGN PATENT DOCUMENTS

| | | |
|---|---|---|
| WO | WO-2015/050501 A1 | 4/2015 |
| WO | WO-2015/089473 A9 | 6/2015 |
| WO | WO-2015089473 A1 * | 6/2015 |
| WO | WO-2015131101 A1 * | 9/2015 |
| WO | WO-2015/173436 A1 | 11/2015 |
| WO | WO-2016/100955 A2 | 6/2016 |
| WO | WO-2016/100955 A3 | 6/2016 |
| WO | WO-2016/196805 A1 | 12/2016 |
| WO | WO-2017/031360 A1 | 2/2017 |

(Continued)

OTHER PUBLICATIONS

Score result for Brower-Toland SEQ No. 1 WO2015131101-A1 published Sep. 3, 2015 (Year: 2015).*

(Continued)

*Primary Examiner* — Catherine S Hibbert

(74) *Attorney, Agent, or Firm* — Quarles & Brady LLP

(57) ABSTRACT

Provided herein are methods and compositions to make guide nucleic acids (gNAs), nucleic acids encoding gNAs, collections of gNAs, and nucleic acids encoding for a collection of gNAs from any source nucleic acid. Also provided herein are methods and compositions to use the resulting gNAs, nucleic acids encoding gNAs, collections of gNAs, and nucleic acids encoding for a collection of gNAs in a variety of applications.

21 Claims, 7 Drawing Sheets

Specification includes a Sequence Listing.

(56) References Cited

FOREIGN PATENT DOCUMENTS

| WO | WO-2017/062723 A9 | 4/2017 |
|---|---|---|
| WO | WO-2017/081097 A1 | 5/2017 |
| WO | WO-2017/100343 A1 | 6/2017 |
| WO | WO-2017/147345 A1 | 8/2017 |
| WO | WO-2018/227025 A1 | 12/2018 |

OTHER PUBLICATIONS

Score result for Wu SEQ No. 1 US2014/0273226 published Sep. 18, 2014 (Year: 2014).*
International Search Report dated May 4, 2017, for PCT Application No. PCT/US2016/065420, filed on Dec. 7, 2016, 8 pages.
Lane, A.B. et al. (2015). "Enzymatically generated CRISPR libraries for genome labeling and screening," *Dev. Cell* 34:373-378.
Loman, N.J. et al. (2012). "High-throughput bacterial genome sequencing: an embarrassment of choice, a world of opportunity," *Nature Review Microbiol.* 10:599-606.
Ran, F.A. et al. (2015). "In vivo genome editing using *Staphylococcus aureus* Cas9," Nature 520:186-191.
Written Opinion of the International Searching Authority dated May 4, 2017, for PCT Application No. PCT/US2016/065420, filed on Dec. 7, 2016, 20 pages.
Ma, M. et al. (2013). "A guide RNA sequence design platform for the CRISPR/Cas9 system for model organism genomes," *Biomed. Res. Int.* vol. 2013, pp. 1-4.
Briner, A.E. et al. (2014). "Guide RNA functional modules direct Cas9 activity and orthogonality," *Mol. Cell.* 56:333-339.
Extended European Search Report dated Aug. 21, 2019, for EP Application No. 16 873 782.3, filed on Dec. 7, 2016, 6 pages.
Koike-Yusa, H. et al. (2014). "Genome-wide recessive genetic screening in mammalian cells with a lentiviral CRISPR-guide RNA library," Nature Biotechnology 32:267-273.
Schmidt, T. et al. (2015). "Synthesis of an arrayed sgRNA library targeting the human genome," Scientific Reports 5:14987, 10 total pages.
Vidigal, J.A. and Ventura, A. (2015). "Rapid and efficient one-step generation of paired gRNA CRISPR-Cas9 libraries," Nature Communications 6:8083, 7 total pages.
Zhou, Y. et al. (2014). "High-throughput screening of a CRISPR/Cas9 library for functional genomics in human cells," Nature 509:487-491, and 11 pages supplemental information,.
International Search Report dated Sep. 25, 2018, for PCT Application No. PCT/US2018/036563, filed on Jun. 7, 2018, 4 pages.
Written Opinion of the International Searching Authority dated Sep. 25, 2018, for PCT Application No. PCT/US2018/036563, filed on Jun. 7, 2018, 37 pages.
U.S. Appl. No. 16/619,055, filed Jun. 7, 2018, by Gourguechon et al. (Copy not attached).

\* cited by examiner

201 Genomic or other source DNA

202 Nt.CviPII and T7 Endonuclease I treatment

203 Ligate T7/MlyI adapters

204 PCR amplify with T7 and MlyI primers

205 Digest with MlyI, separates HGG from gRNA targeting sequence

206 Ligate gRNA stem-loop sequences

METHODS AND COMPOSITIONS FOR THE MAKING AND USING OF GUIDE NUCLEIC ACIDS

CROSS-REFERENCE

This is a U.S. National Stage Application under 35 U.S.C. § 371 of International Application No. PCT/US2016/065420, filed on Dec. 7, 2016, which claims the benefit of U.S. Provisional Application No. 62/264,262, filed Dec. 7, 2015, and of U.S. Provisional Application No. 62/298,963, filed Feb. 23, 2016, each of which is hereby incorporated by reference in its entirety.

INCORPORATION BY REFERENCE OF SEQUENCE LISTING

The present application is being filed with a Sequence Listing in electronic format. The Sequence Listing is provided as a file entitled ARCB-003/02US_SeqList.txt, created Nov. 19, 2018, which is 816,892 bytes in size. The information in electronic format of the Sequence Listing is incorporated by reference in its entirety.

BACKGROUND

Human clinical DNA samples and sample libraries such as cDNA libraries derived from RNA contain highly abundant sequences that have little informative value and increase the cost of sequencing. While methods have been developed to deplete these unwanted sequences (e.g., via hybridization capture), these methods are often time-consuming and can be inefficient.

Although a guide nucleic acid (gNA) mediated nuclease systems (such as guide RNA (gRNA)-mediated Cas systems) can efficiently deplete any target DNA, targeted depletion of very high numbers of unique DNA molecules is not feasible. For example, a sequencing library derived from human blood may contain >99% human genomic DNA. Using a gRNA-mediated Cas9 system-based method to deplete this genomic DNA to detect an infectious agent circulating in the human blood would require extremely high numbers of gRNAs (about 10-100 million gRNAs), in order to ensure that a gRNA will be present every 30-50 base pairs (bp), and that no target DNA will be missed. Very large numbers of gRNAs can be predicted computationally and then synthesized chemically, but at a prohibitively expensive cost.

Therefore, there is a need in the art to provide a cost-effective method of converting any DNA into a gNA (e.g., gRNA) library to enable, for example, genome-wide depletion of unwanted DNA sequences from those of interest, without prior knowledge about their sequences. Provided herein are methods and compositions that address this need.

SUMMARY

Provided herein are compositions and methods to generate gNAs and collections of gNAs from any source nucleic acid. For example, gRNAs and collections of gRNAs can be generated from source DNA, such as genomic DNA. Such gNAs and collections of the same are useful for a variety of applications, including depletion, partitioning, capture, or enrichment of target sequences of interest, genome-wide labeling, genome-wide editing, genome-wide functional screens, and genome-wide regulation.

In one aspect, the invention described herein provides a collection of nucleic acids, a plurality of the nucleic acids in the collection comprising: a first segment comprising a regulatory region; a second segment encoding a targeting sequence; and a third segment encoding a nucleic acid-guided nuclease system protein-binding sequence, wherein at least 10% of the nucleic acids in the collection vary in size. In another aspect, the invention described herein provides a collection of nucleic acids, a plurality of the nucleic acids in the collection comprising: a first segment comprising a regulatory region; a second segment encoding a targeting sequence, wherein the size of the second segment is greater than 21 bp; and a third segment encoding a nucleic acid-guided nuclease system protein-binding sequence. In some embodiments, the nucleic acid-guided nuclease system protein is a CRISPR/Cas system protein. In some embodiments, the size of the second segment varies from 15-250 bp across the collection of nucleic acids. In some embodiments, at least 10% of the second segments in the collection are greater than 21 bp. In some embodiments, the size of the second segment is not 20 bp. In some embodiments, the size of the second segment is not 21 bp. In some embodiments, the collection of nucleic acids is a collection of DNA. In some embodiments, the second segment is single stranded DNA. In some embodiments, the third segment is single stranded DNA. In some embodiments, the second segment is double stranded DNA. In some embodiments, the third segment is double stranded DNA. In some embodiments, the regulatory region is a region capable of binding a transcription factor. In some embodiments, the regulatory region comprises a promoter. In some embodiments, the promoter is selected from the group consisting of T7, SP6, and T3. In some embodiments, the targeting sequence is directed at a mammalian genome, eukaryotic genome, prokaryotic genome, or a viral genome. In some embodiments, the targeting sequence is directed at repetitive or abundant DNA. In some embodiments, the targeting sequence is directed at mitochondrial DNA, ribosomal DNA, Alu DNA, centromeric DNA, SINE DNA, LINE DNA, or STR DNA. In some embodiments, the sequence of the second segments is selected from Table 3 and/or Table 4. In some embodiments, the collection comprises at least $10^2$ unique nucleic acid molecules. In some embodiments, the targeting sequence is at least 80% complementary to the strand opposite to a sequence of nucleotides 5' to a PAM sequence. In some embodiments, the collection comprises targeting sequences directed to sequences of interest spaced about every 10,000 bp or less across the genome of an organism. In some embodiments, the PAM sequence is AGG, CGG, or TGG. In some embodiments, the PAM sequence is specific for a CRISPR/Cas system protein selected from the group consisting of Cas9, Cpf1, Cas3, Cas8a-c, Cas10, Cse1, Csy1, Csn2, Cas4, Csm2, and Cm5. In some embodiments, the third segment comprises DNA encoding a gRNA stem-loop sequence. In some embodiments, the third segment encodes for a RNA comprising the sequence GUUUUAGAGCUAGAAAUAGCAAGUUAAAAUAAGGCUAGUCCGUUAUCAACUUGAAAAAGUGGCACCGAGUCGGUGCUUUUUUU (SEQ ID NO: 1) or encodes for a RNA comprising the sequence GUUUUAGAGCUAUGCUGAAACAGCAUAGCAAGUUAAAAUAAGGCUAGUCCGUUAUCAACUUGA AAAAGUGGCACCGAGUCGGUGCUUUUUUC (SEQ ID NO: 2). In some embodiments, the sequence of the third segment encodes for a crRNA and a tracrRNA. In some embodiments, the nucleic acid-guided nuclease system protein is from a bacterial species. In some embodiments, the nucleic acid-guided nuclease system protein is from an archaea species. In some embodiments, the CRISPR/Cas system protein is a Type I, Type II, or Type III protein. In some embodiments, the CRISPR/Cas system protein is selected from the group consisting of Cas9, Cpf1, Cas3, Cas8a-c, Cas10, Cse1, Csy1, Csn2, Cas4, Csm2, Cm5, dCas9 and cas9 nickase. In some embodiments, the third segment comprises DNA encoding a Cas9-binding sequence. In some embodiments, a plurality of third segments of the collection encode for a first nucleic acid-guided nuclease system protein binding sequence, and a plurality of the third segments of the collection encode for a second nucleic acid-guided nuclease system protein binding sequence. In some embodiments, the third segments of the collection encode for a plurality of different binding sequences of a plurality of different binding sequences of a plurality of different nucleic acid-guided nuclease system proteins.

In another aspect, the invention described herein provides for a collection of guide RNAs (gRNAs), comprising: a first RNA segment a targeting sequence; and a second RNA segment comprising a nucleic acid-guided nuclease system protein-binding sequence, wherein at least 10% of the gRNAs in the collection vary in size. In some embodiments, the nucleic acid-guided nuclease system protein is a CRISPR/Cas system protein. In some embodiments, the size of the first segment varies from 15-250 bp across the collection of gRNAs. In some embodiments, the at least 10% of the first segments in the collection are greater than 21 bp. In some embodiments, the size of the first segment is not 20 bp. In some embodiments, the size of the first segment is not 21 bp. In some embodiments, the targeting sequence is directed at a mammalian genome, eukaryotic genome, prokaryotic genome, or viral genome. In some embodiments, the targeting sequence is directed at repetitive or abundant DNA. In some embodiments, the targeting sequence is directed at mitochondrial DNA, ribosomal DNA, Alu DNA, centromeric DNA, SINE DNA, LINE DNA, or STR DNA. In some embodiments, the sequence of the first segments is RNA encoded by sequences selected from Table 3 and/or Table 4. In some embodiments, the collection comprises at least $10^2$ unique gRNAs. In some embodiments, the gRNAs comprise cytosine, guanine, and adenine. In some embodiments, a subset of the gRNAs further comprises thymine. In some embodiments, a subset of the gRNAs further comprises uracil. In some embodiments, the first segment is at least 80% complementary to a target genomic sequence of interest. In some embodiments, the targeting sequence is at least 80% complementary to the strand opposite to a sequence of nucleotides 5' to a PAM sequence. In some embodiments the PAM sequence is AGG, CGG, or TGG. In some embodiments, the PAM sequence is specific for a CRISPR/Cas system protein selected from the group consisting of Cas9, Cpf1, Cas3, Cas8a-c, Cas10, Cse1, Csy1, Csn2, Cas4, Csm2, and Cm5. In some embodiments, the second segment comprises a gRNA stem-loop sequence. In some embodiments, the third segment comprises DNA encoding a gRNA stem-loop sequence. In some embodiments, the third segment comprises the sequence GUUUUAGAGCUAGAAAUAG-CAAGUUAAAAUAAGGCUAGUCCGUUAUCAAC-UUGAAAAAGUGGCA CCGAGUCGGUGCUUUUUUU (SEQ ID NO: 1) or comprises the sequence GUUUUA-GAGCUAUGCUGGAAACAGCAUAG-CAAGUUAAAAUAAGGCUAGUCCGUUAUCAAC-UUGA AAAAGUGGCACCGAGUCGGUGCUUUUUUC (SEQ ID NO: 2). In some embodiments, the second segment comprises a crRNA and a tracrRNA. In some embodiments, the nucleic acid-guided nuclease system protein is from a bacterial species. In some embodiments, the nucleic acid-guided nuclease system protein is from an archaea species. In some embodiments, the CRISPR/Cas system protein is a Type I, Type II, or Type III protein. In some embodiments, the CRISPR/Cas system protein is selected from the group consisting of Cas9, Cpf1, Cas3, Cas8a-c, Cas10, Cse1, Csy1, Csn2, Cas4, Csm2, Cm5, dCas9 and cas9 nickase. In some embodiments, the second segment comprises a Cas9-binding sequence. In some embodiments, at least 10% of the gRNAs in the collection vary in their 5' terminal-end sequence. In some embodiments, the collection comprises targeting sequences directed to sequences of interest spaced every 10,000 bp or less across the genome of an organism. In some embodiments, a plurality of second segments of the collection comprise a first nucleic acid-guided nuclease system protein binding sequence, and a plurality of the second segments of the collection comprise a second nucleic acid-guided nuclease system protein binding sequence. In some embodiments, the second segments of the collection comprise a plurality of different binding sequences of a plurality of different nucleic acid-guided nuclease system proteins. In some embodiments, a plurality of the gRNAs of the collection are attached to a substrate. In some embodiments, a plurality of the gRNAs of the collection comprise a label. In some particular embodiments, a plurality of the gRNAs of the collection comprise different labels.

In another aspect, the invention described herein provides nucleic acid comprising: a first segment comprising a regulatory region; a second segment encoding a targeting sequence, wherein the targeting sequence is greater than 30 bp; and a third segment encoding a nucleic acid encoding a nucleic acid-guided nuclease system protein-binding sequence. In some embodiments, the nucleic acid-guided nuclease is a CRISPR/Cas system protein. In some embodiments, the nucleic acid is DNA. In some embodiments, the second segment is single stranded DNA. In some embodiments, the third segment is single stranded DNA. In some embodiments, the second segment is double stranded DNA. In some embodiments, the third segment is double stranded DNA. In some embodiments, the regulatory region is a region capable of binding a transcription factor. In some embodiments, the regulatory region comprises a promoter. In some embodiments, the promoter is selected from the group consisting of T7, SP6, and T3. In some embodiments, the targeting sequence is directed at a mammalian genome, eukaryotic genome, prokaryotic genome, or a viral genome. In some embodiments, the targeting sequence is directed at abundant or repetitive DNA. In some embodiments, the targeting sequence is directed at mitochondrial DNA, ribosomal DNA, Alu DNA, centromeric DNA, SINE DNA, LINE DNA, or STR DNA. In some embodiments, the sequence of the second segments is selected from Table 3 and/or Table 4. In some embodiments, the targeting sequence is at least 80% complementary to the strand opposite to a sequence of nucleotides 5' to a PAM sequence. In some embodiments, the target genomic sequence of interest is 5' upstream of a PAM sequence. In some embodiments, the PAM sequence is specific for a CRISPR/Cas system protein selected from the group consisting of Cas9, Cpf1, Cas3, Cas8a-c, Cas10, Cse1, Csy1, Csn2, Cas4, Csm2, and Cm5. In some embodiments, the third segment comprises DNA encoding a gRNA stem-loop sequence. In some embodiments, the third segment comprises DNA encoding a gRNA stem-loop sequence. In some embodiments, the third segment encodes for a RNA comprising the sequence GUUUAGAGCUAGAAAUAGCAAGUUAAAAUAAGGCUAGUCCGUUAUCAACUUGAAAAAGUGGCA CCGAGUCGGUGCUUUUUU (SEQ ID NO: 1) or encodes for a RNA comprising the sequence GUUUAGAGCUAUGCUGGAAACAGCAUAGCAAGUUAAAAUAAGGCUAGUCCGUUAUCAACUUGA AAAAGUGGCACCGAGUCGGUGCUUUUUUC (SEQ ID NO: 2). In some embodiments, the nucleic acid-guided nuclease system protein is from a bacterial species. In some embodiments, the nucleic acid-guided nuclease system protein is from an archaea species. In some embodiments, the CRISPR/Cas system protein is a Type I, Type II, or Type III protein. In some embodiments, the CRISPR/Cas system protein is selected from the group consisting of Cas9, Cpf1, Cas3, Cas8a-c, Cas10, Cse1, Csy1, Csn2, Cas4, Csm2, Cm5, dCas9 and cas9 nickase. In some embodiments, the third segment comprises DNA encoding a Cas9-binding sequence.

In another aspect, the invention described herein provides a guide RNA comprising a first segment comprising a targeting sequence, wherein the size of the first segment is greater than 30 bp; and a second segment comprising a nucleic acid-guided nuclease system protein-binding sequence. In some embodiments, the nucleic acid-guided nuclease is a CRISPR/Cas system protein. In some embodiments, the gRNA comprises an adenine, a guanine, and a cytosine. In some embodiments, the gRNA further comprises a thymine. In some embodiments, the gRNA further comprises a uracil. In some embodiments, the size of the first RNA segment is between 30 and 250 bp. In some embodiments, the targeting sequence is directed at a mammalian genome, eukaryotic genome, prokaryotic genome, or viral genome. In some embodiments, the targeting sequence is directed at repetitive or abundant DNA. In some embodiments, the targeting sequence is directed at mitochondrial DNA, ribosomal DNA, Alu DNA, centromeric DNA, SINE DNA, LINE DNA, or STR DNA. In some embodiments, the first segment is at least 80% complementary to the target genomic sequence of interest. In some embodiments, the targeting sequence is at least 80% complementary to the strand opposite to a sequence of nucleotides 5' to a PAM sequence. In some embodiments, the second segment comprises a gRNA stem-loop sequence. In some embodiments, the sequence of the second segment comprises GUUUAGAGCUAGAAAUAGCAAGUUAAAAUAAGGCUAGUCCGUUAUCAACUUGAAAAAGUGGCA CCGAGUCGGUGCUUUUUUU (SEQ ID NO: 1) or comprises the sequence GUUUAGAGCUAUGCUGGAAACAGCAUAGCAAGUUAAAAUAAGGCUAGUCCGUUAUCAACUUGA AAAAGUGGCACCGAGUCGGUGCUUUUUUC (SEQ ID NO: 2). In some embodiments, the sequence of the third segment comprises a crRNA and a tracrRNA. In some embodiments, the nucleic acid-guided nuclease system protein is from a bacterial species. In some embodiments, the nucleic acid-guided nuclease system protein is from an archaea species. In some embodiments, the CRISPR/Cas system protein is a Type I, Type II, or Type III protein. In some embodiments, the CRISPR/Cas system protein is selected from the group consisting of Cas9, Cpf1, Cas3, Cas8a-c, Cas10, Cse1, Csy1, Csn2, Cas4, Csm2, Cm5, dCas9 and cas9 nickase. In some embodiments, the second segment is a Cas9-binding sequence.

In another aspect, the invention provides a complex comprising a nucleic acid-guided nuclease system protein and a comprising a first segment comprising a targeting sequence, wherein the size of the first segment is greater than 30 bp; and a second segment comprising a nucleic acid-guided nuclease system protein-binding sequence.

In another aspect, the invention described herein provides a method for depleting and partitioning of targeted sequences in a sample, enriching a sample for non-host nucleic acids, or serially depleting targeted nucleic acids in a sample comprising: providing nucleic acids extracted from a sample; and contacting the sample with a plurality of complexes comprising (i) any one of the collection of gRNAs provided herein; and (ii) nucleic acid-guided nuclease system proteins. In some embodiments, the nucleic acid-guided nuclease system proteins are CRISPR/Cas system proteins. In some embodiments, the CRISPR/Cas system proteins are Cas9 proteins.

In another aspect, the invention provides a method of making a collection of nucleic acids, each comprising a DNA encoding a targeting sequence ligated to a DNA encoding a nucleic acid-guided nuclease system protein-binding sequence, comprising: (a) providing double-stranded DNA molecules, each comprising a sequence of interest 5' to a PAM sequence, and its reverse complementary sequence on the opposite strand; (b) performing an enzymatic digestion reaction on the double stranded DNA molecules, wherein cleavages are generated at the PAM sequence and/or its reverse complementary sequence on the opposite strand, but never completely remove the PAM sequence and/or its reverse complementary sequence on the opposite strand from the double stranded DNA; (c) ligating adapters comprising a recognition sequence to the resulting DNA molecules of step b; (d) contacting the DNA molecules of step c with an restriction enzyme that recognizes the recognition sequence of step c, whereby generating DNA fragments comprising blunt-ended double strand breaks immediately 5' to the PAM sequence, whereby removing the PAM sequence and the adapter containing the enzyme recognition site; and (e) ligating the resulting double stranded DNA fragments of step d with a DNA encoding a nucleic acid-guided nuclease system protein-binding sequence, whereby generating a plurality of DNA fragments, each comprising a DNA encoding a targeting sequence ligated to a DNA encoding a nucleic acid-guided nuclease system protein-binding sequence. In some embodiments, the nucleic acid-guided nuclease is a CRISPR/Cas nucleic acid-guided nuclease system protein. In some embodiments, the starting DNA molecules of the collection further comprise a regulatory sequence upstream of the sequence of interest 5' to the PAM sequence. In some embodiments, the regulatory sequence comprises a promoter. In some embodiments, the promoter comprises a T7, Sp6, or T3 sequence. In some embodiments, the double stranded DNA molecules are genomic DNA, intact DNA, or sheared DNA. In some embodiments, the genomic DNA is human, mouse, avian, fish, plant, insect, bacterial, or viral. In some embodiments, the DNA segments encoding a targeting sequence are at least 22 bp. In some embodiments, the DNA segments encoding a targeting sequence are 15-250 bp in size range. In some embodiments, the PAM sequence is AGG, CGG, or TGG. In some embodiments, the PAM sequence is specific for a CRISPR/Cas system protein selected from the group consisting of Cas9, Cpf1, Cas3, Cas8a-c, Cas10, Cse1, Csy1, Csn2, Cas4, Csm2, and Cm5. In some embodiments, step (b) further comprises (1) contacting the DNA molecules with an enzyme capable of creating a nick in a single strand at a CCD site, whereby generating a plurality of nicked double stranded DNA molecules, each comprising a sequence of interest followed by an HGG sequence, wherein the DNA molecules are nicked at the CCD sites; and (2) contacting the nicked double stranded DNA molecules with an endonuclease, whereby generating a plurality of double stranded DNA fragments, each comprising a sequence of interest followed by an NGG sequence wherein residual nucleotides from HGG and/or CCD sequences is (are) left behind. In some embodiments, step (d) further comprises PCR amplification of the adaptor-ligated DNA fragments from step (c) before cutting with the restriction enzyme recognizing the recognition sequence of step (c), wherein after PCR, the recognition sequence is positioned 3' of the PAM sequence, and a regulatory sequence is positioned at the 5' distal end of the PAM sequence. In some embodiments, the enzymatic reaction of step (b) comprises the use of a Nt.CviPII enzyme, and a T7 Endonuclease I enzyme. In some embodiments, step (c) further comprises a blunt-end reaction with a T4 DNA Polymerase, if the adapter to be ligated does not comprise an overhang. In some embodiments, the adapter of step (c) is either (1) double stranded, comprising a restriction enzyme recognition sequence in one strand, and a regulatory sequence in the other strand, if the adapter is Y-shaped and comprises an overhang; or (2) has a palindromic enzyme recognition sequence in both strands, if the adapter is not Y-shaped. In some embodiments, the restriction enzyme of step (d) is MlyI. In some embodiments, the restriction enzyme of step (d) is BaeI. In some embodiments, step (d) further comprises contacting the DNA molecules with an XhoI enzyme. In some embodiments, in step (e) the DNA encoding a nucleic acid-guided nuclease system-protein binding sequence encodes for a RNA comprising the sequence GUUUUAGAGCUAGAAAUAG-CAAGUUAAAAUAAGGCUAGUCCGUUAUCAAC-UUGAAAAAGUGGCA CCGAGUCGGUGCUUUUUUU (SEQ ID NO: 1) or encodes for a RNA comprising the sequence GUUUUAGAGCUAUGCUGGAAACAG-CAUAGCAAGUUAAAAUAAGGCUAGUCCGUUAU-CAACUUGA AAAAGUGGCACCGAGUCGGUGC-UUUUUUUC (SEQ ID NO: 2). In some embodiments, the targeted sequences of interest are spaced every 10,000 bp or less across the genome of an organism.

In another aspect, the invention provides a method of making a collection of nucleic acids, each comprising a DNA encoding a targeting sequence ligated to a DNA encoding a nucleic acid-guided nuclease system protein-binding sequence, comprising: (a) providing a plurality of double stranded DNA molecules, each comprising a sequence of interest, an NGG site, and its complement CCN site; (b) contacting the molecules with an enzyme capable of creating a nick in a single strand at a CCN site, whereby generating a plurality of nicked double stranded DNA molecules, each comprising a sequence of interest 5' to the NGG site, wherein the DNA molecules are nicked at the CCD sites; (c) contacting the nicked double stranded DNA molecules with an endonuclease, whereby generating a plurality of double stranded DNA fragments, each comprising a sequence of interest, wherein the fragments comprise an terminal overhang; (d) contacting the double stranded DNA fragments with an enzyme without 5' to 3' exonuclease activity to blunt end the double stranded DNA fragments, whereby generating a plurality of blunt ended double stranded fragments, each comprising a sequence of interest; (e) contacting the blunt ended double stranded fragments of step d with an enzyme that cleaves the terminal NGG site; and (f) ligating the resulting double stranded DNA fragments of step e with a DNA encoding a nucleic acid-guided nuclease system-protein binding sequence, whereby generating a plurality of DNA fragments, each comprising a targeting sequence ligated to a DNA encoding a nucleic acid-guided nuclease system protein-binding sequence. In some embodiments, the nucleic acid-guided nuclease is a CRISPR/Cas system protein. In some embodiments, the plurality of double stranded DNA molecules have a regulatory sequence 5' upstream of the NGG sites. In some embodiments, the regulatory sequence comprises a T7, SP6, or T3 sequence. In some embodiments, the NGG site comprises AGG, CGG, or TGG, and the CCN site comprises CCT, CCG, or CCA. In some embodiments, the plurality of double stranded DNA molecules, each comprising a sequence of interest comprise sheared fragments of genomic DNA. In some embodiments, the genomic DNA is mammalian, prokaryotic, eukaryotic, avian, bacterial or viral. In some embodiments, the plurality of double stranded DNA molecules in step (a) are at least 500 bp. In some embodiments, the enzyme in step b is a Nt.CviPII enzyme. In some embodiments, the enzyme in step c is a T7 Endonuclease I. In some embodiments, the enzyme in step d is a T4 DNA Polymerase. In some embodiments, in step f the DNA encoding a nucleic acid-guided nuclease system-protein binding sequence encodes for a RNA comprising the sequence GUUUUAGAGCUAGAAAUAG-CAAGUUAAAAUAAGGCUAGUCCGUUAUCAAC-UUGAAAAAGUGGCA CCGAGUCGGUGCUUUUUUU (SEQ ID NO: 1) or encodes for a RNA comprising the sequence GUUUUAGAGCUAUGCUGGAAACAG-CAUAGCAAGUUAAAAUAAGGCUAGUCCGUUAU-CAACUUGA AAAAGUGGCACCGAGUCGGUGC-UUUUUUUC (SEQ ID NO: 2). In some embodiments, the step e additionally comprises ligating adaptors carrying a MlyI recognition site and digesting with MlyI enzyme. In some embodiments, the sequence of interest is spaced every 10,000 bp or less across the genome.

In another aspect, the invention provides a method of making a collection of nucleic acids, each comprising a DNA encoding a targeting sequence and a DNA encoding a nucleic acid-guided nuclease system protein-binding sequence, comprising: (a) providing genomic DNA comprising a plurality of sequences of interest, comprising NGG and CCN sites; (b) contacting the genomic DNA with an enzyme capable of creating nicks in the genomic DNA, whereby generating nicked genomic DNA, nicked at CCN sites; (c) contacting the nicked genomic DNA with an endonuclease, whereby generating double stranded DNA fragments, with an overhang; (d) ligating the DNA with overhangs from step c to a Y-shaped adapter, thereby introducing a restriction enzyme recognition sequence only at 3' of the NGG site and a regulatory sequence 5' of the sequence of interest; (e) contacting the product from step d with an enzyme that cleaves away the NGG site together with the adaptor carrying the enzyme recognition sequence; and (f) ligating the resulting double stranded DNA fragments of step e with a DNA encoding a nucleic acid-guided nuclease system protein-binding sequence, whereby generating a plurality of DNA fragments, each comprising a sequence of interest ligated to a DNA encoding a nucleic acid-guided nuclease system protein-binding sequence. In some embodiments, the nucleic acid-guided nuclease is a CRISPR/Cas system protein. In some embodiments, the NGG site comprises AGG, CGG, or TGG, and CCN site comprises CCT, CCG, or CCA. In some embodiments, the regulatory sequence comprises a promoter sequence. In some embodiments, the promoter sequence comprises a T7, SP6, or T3 sequence. In some embodiments, the DNA fragments are sheared fragments of genomic DNA.

In some embodiments, the genomic DNA is mammalian, prokaryotic, eukaryotic, or viral. In some embodiments, the fragments are at least 200 bp. In some embodiments, the enzyme in step b is a Nt.CviPII enzyme. In some embodiments, the enzyme in step c is a T7 Endonuclease I. In some embodiments, step d further comprises PCR amplification of the adaptor-ligated DNA. In some embodiments, in step f, the DNA encoding nucleic acid-guided nuclease system protein-binding sequence encodes for a RNA comprising the sequence GUUUUAGAGCUAGAAAUAGCAAGUUAAAAUAAGGCUAGUCCGUUAUCAACUUGAAAAAGUGGCA CCGAGUCGGUGCUUUUUUU (SEQ ID NO: 1) or encodes for a RNA comprising the sequence GUUUUAGAGCUAUGCUGGAAACAGCAUAGCAAGUUAAAAUAAGGCUAGUCCGUUAUCAACUUGA AAAAGUGGCACCGAGUCGGUGCUUUUUUC (SEQ ID NO: 2). In some embodiments, the enzyme removing NGG site in step e is MlyI. In some embodiments, the target of interest of the collection is spaced every 10,000 bp or less across the genome.

In another aspect, the invention provides kits and/or reagents useful for performing a method of making a collection of nucleic acids, each comprising a DNA encoding a targeting sequence ligated to a DNA encoding a nucleic acid-guided nuclease system protein-binding sequence, as described in the embodiments herein.

In another aspect, the invention described herein provides kit comprising a collection of nucleic acids, a plurality of the nucleic acids in the collection comprising: a first segment comprising a regulatory region; a second segment encoding a targeting sequence; and a third segment encoding a CRISPR/Cas system protein-binding sequence, wherein at least 10% of the nucleic acids in the collection vary in size.

In another aspect, the invention described herein provides a kit comprising a collection of nucleic acids, a plurality of the nucleic acids in the collection comprising: a first segment comprising a regulatory region; a second segment encoding a targeting sequence, wherein the size of the second segment is greater than 21 bp; and a third segment encoding a CRISPR/Cas system protein-binding sequence.

In another aspect, the invention described herein provides a kit comprising a collection of guide RNAs comprising a first RNA segment a targeting sequence; and a second RNA segment comprising a CRISPR/Cas system protein-binding sequence, wherein at least 10% of the gRNAs in the collection vary in size.

In another aspect, the invention described herein provides a method of making a collection of guide nucleic acids, comprising: a. obtaining abundant cells in a source sample; b. collecting nucleic acids from said abundant cells; and c. preparing a collection of guide nucleic acids (gNAs) from said nucleic acids. In some embodiments, said abundant cells comprise cells from one or more most abundant bacterial species in said source sample. In some embodiments, said abundant cells comprise cells from more than one species. In some embodiments, said abundant cells comprise human cells. In some embodiments, said abundant cells comprise animal cells. In some embodiments, said abundant cells comprise plant cells. In some embodiments, said abundant cells comprise bacterial cells. In some embodiments, the method further comprises contacting nucleic acid-guided nucleases with said library of gNAs to form nucleic acid-guided nuclease-gNA complexes. In some embodiments, the method further comprises using said nucleic acid-guided nuclease-gNA complexes to cleave target nucleic acids at target sites, wherein said gNAs are complementary to said target sites. In some embodiments, said target nucleic acids are from said source sample. In some embodiments, a species of said target nucleic acids is the same as a species of said source sample. In some embodiments, said species of said target nucleic acids and said species of said source sample is human. In some embodiments, said species of said target nucleic acids and said species of said source sample is animal. In some embodiments, said species of said target nucleic acids and said species of said source sample is plant.

In another aspect, the invention described herein provides a method of making a collection of nucleic acids, each comprising a targeting sequence, comprising: a. obtaining source DNA; b. nicking said source DNA with a nicking enzyme at nicking enzyme recognition sites, thereby producing double-stranded breaks at proximal nicks; and c. repairing overhangs of said double-stranded breaks, thereby producing a double-stranded fragment comprising (i) a targeting sequence and (ii) said nicking enzyme recognition site. In another aspect, the invention described herein provides a method of making a collection of nucleic acids, each comprising a targeting sequence, comprising: a. obtaining source DNA; b. nicking said source DNA with a nicking enzyme at nicking enzyme recognition sites, thereby producing a nick; and c. synthesizing a new strand from said nick, thereby producing a single-stranded fragment of said source DNA comprising a targeting sequence. In some embodiments, the method further comprises producing a double-stranded fragment comprising said targeting sequence from said single-stranded fragment. In some embodiments, said producing said double-stranded fragment comprises random priming and extension. In some embodiments, said random priming is conducted with a primer comprising a random n-mer region and a promoter region. In some embodiments, said random n-mer region is a random hexamer region. In some embodiments, said random n-mer region is a random octamer region. In some embodiments, said promoter region is a T7 promoter region. In some embodiments, the method further comprises ligating a nuclease recognition site nucleic acid comprising a nuclease recognition site to said double-stranded fragment. In some embodiments, said nuclease recognition site corresponds to a nuclease that cuts at a distance from said nuclease recognition site equal to the length of said nicking enzyme recognition sites. In some embodiments, said nuclease recognition site is a MlyI recognition site. In some embodiments, said nuclease recognition site is a BaeI recognition site. In some embodiments, the method further comprises digesting said double-stranded fragment with said nuclease, thereby removing said nicking enzyme recognition site from said double-stranded fragment. In some embodiments, the method further comprises ligating said double-stranded fragment to a nucleic acid-guided nuclease system protein recognition site nucleic acid comprising a nucleic acid-guided nuclease system protein recognition site. In some embodiments, said nucleic acid-guided nuclease system protein recognition site comprises a guide RNA stem-loop sequence. In some embodiments, said nuclease recognition site corresponds to a nuclease that cuts at a distance from said nuclease recognition site equal to a length of said targeting sequence. In some embodiments, said length of said targeting sequence is 20 base pairs. In some embodiments, said nuclease recognition site is a MmeI recognition site. In some embodiments, the method further comprises digesting said double-stranded fragment with said nuclease. In some embodiments, said nuclease recognition site corresponds to a nuclease that cuts at a distance from said nuclease recognition site equal to a length of said targeting sequence plus a length of said nicking enzyme recognition sites. In some embodiments, said length of said targeting sequence plus a length of said nicking enzyme recognition sites is 23 base pairs. In some embodiments, said nuclease recognition site is a EcoP15I recognition site. In some embodiments, the method further comprises digesting said double-stranded fragment with said nuclease. In some embodiments, the method further comprises ligating said double-stranded fragment to a nucleic acid-guided nuclease system protein recognition site nucleic acid comprising a nucleic acid-guided nuclease system protein recognition site. In some embodiments, said nucleic acid-guided nuclease system protein recognition site comprises a guide RNA stem-loop sequence.

In another aspect, the invention described herein provides a kit comprising all essential reagents and instructions for carrying out the methods of aspects of the invention described herein.

DETAILED DESCRIPTION OF THE INVENTION

Figure 1:
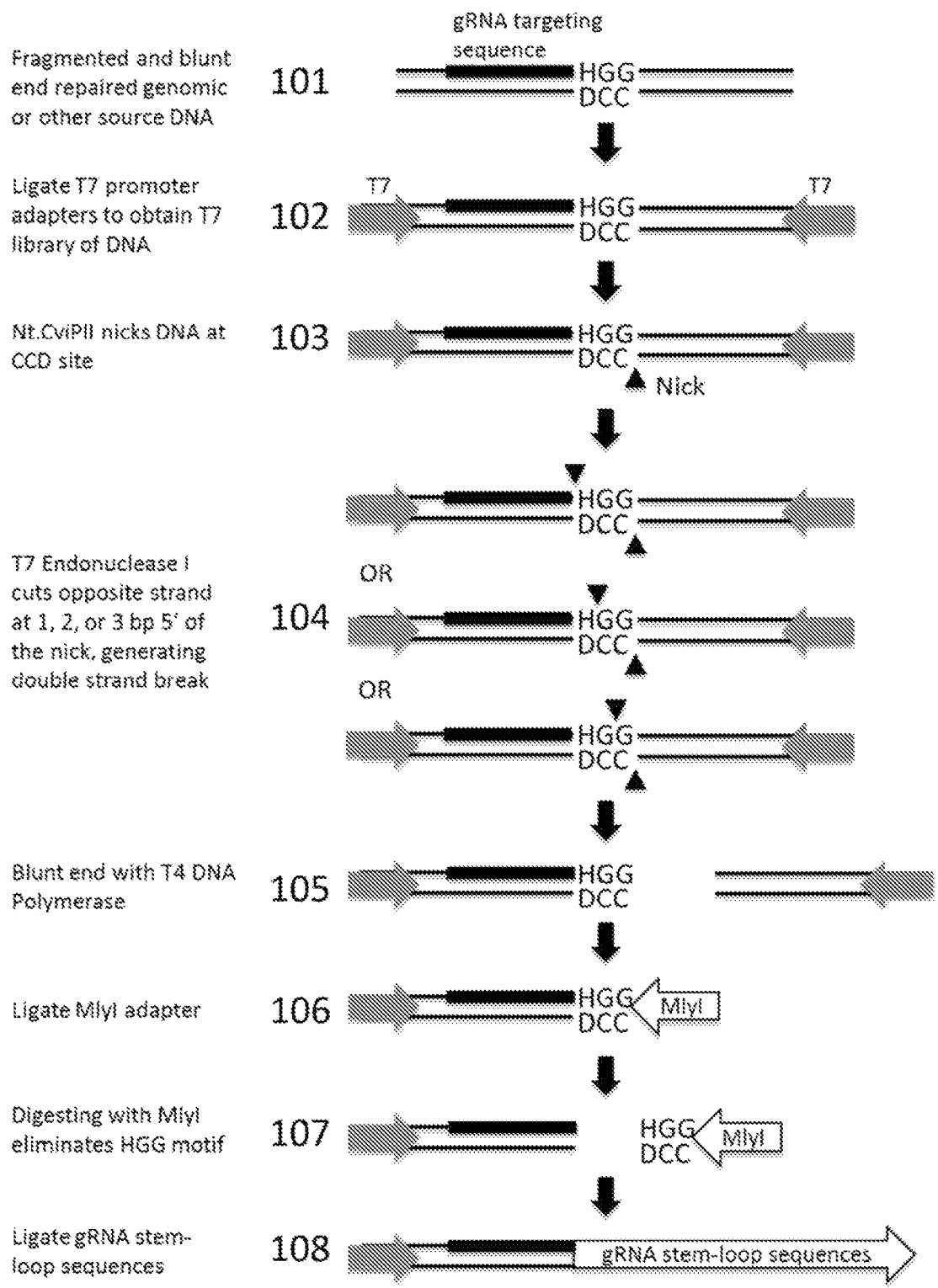
FIG. 1 illustrates an exemplary scheme for producing a collection of gRNAs (a gRNA library) from genomic DNA.

There is a need in the art for a scalable, low-cost approach to generate large numbers of diverse guide nucleic acids (gNAs) (e.g., gRNAs, gDNAs) for a variety of downstream applications.

Unless defined otherwise herein, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are described.

Numeric ranges are inclusive of the numbers defining the range.

For purposes of interpreting this specification, the following definitions will apply and whenever appropriate, terms used in the singular will also include the plural and vice versa. In the event that any definition set forth below conflicts with any document incorporated herein by reference, the definition set forth shall control.

As used herein, the singular form "a", "an", and "the" includes plural references unless indicated otherwise.

It is understood that aspects and embodiments of the invention described herein include "comprising," "consisting," and "consisting essentially of" aspects and embodiments.

The term "about" as used herein refers to the usual error range for the respective value readily known to the skilled person in this technical field. Reference to "about" a value or parameter herein includes (and describes) embodiments that are directed to that value or parameter per se.

The term "nucleic acid," as used herein, refers to a molecule comprising one or more nucleic acid subunits. A nucleic acid can include one or more subunits selected from adenosine (A), cytosine (C), guanine (G), thymine (T) and uracil (U), and modified versions of the same. A nucleic acid comprises deoxyribonucleic acid (DNA), ribonucleic acid (RNA), combinations, or derivatives thereof. A nucleic acid may be single-stranded and/or double-stranded.

The nucleic acids comprise "nucleotides", which, as used herein, is intended to include those moieties that contain purine and pyrimidine bases, and modified versions of the same. Such modifications include methylated purines or pyrimidines, acylated purines or pyrimidines, alkylated riboses or other heterocycles. In addition, the term "nucleotide" or "polynucleotide" includes those moieties that contain hapten or fluorescent labels and may contain not only conventional ribose and deoxyribose sugars, but other sugars as well. Modified nucleosides, nucleotides or polynucleotides also include modifications on the sugar moiety, e.g., wherein one or more of the hydroxyl groups are replaced with halogen atoms or aliphatic groups, or are functionalized as ethers, amines, or the like.

The term "nucleic acids" and "polynucleotides" are used interchangeably herein. Polynucleotide is used to describe a nucleic acid polymer of any length, e.g., greater than about 2 bases, greater than about 10 bases, greater than about 100 bases, greater than about 500 bases, greater than 1000 bases, up to about 10,000 or more bases composed of nucleotides, e.g., deoxyribonucleotides or ribonucleotides, and may be produced enzymatically or synthetically (e.g., PNA as described in U.S. Pat. No. 5,948,902 and the references cited therein) which can hybridize with naturally occurring nucleic acids in a sequence specific manner analogous to that of two naturally occurring nucleic acids, e.g., can participate in Watson-Crick base pairing interactions. Naturally-occurring nucleotides include guanine, cytosine, adenine and thymine (G, C, A and T, respectively). DNA and RNA have a deoxyribose and ribose sugar backbones, respectively, whereas PNA's backbone is composed of repeating N-(2-aminoethyl)-glycine units linked by peptide bonds. In PNA various purine and pyrimidine bases are linked to the backbone by methylene carbonyl bonds. A locked nucleic acid (LNA), often referred to as inaccessible RNA, is a modified RNA nucleotide. The ribose moiety of an LNA nucleotide is modified with an extra bridge connecting the 2' oxygen and 4' carbon. The bridge "locks" the ribose in the 3'-endo (North) conformation, which is often found in the A-form duplexes. LNA nucleotides can be mixed with DNA or RNA residues in the oligonucleotide whenever desired. The term "unstructured nucleic acid," or "UNA," is a nucleic acid containing non-natural nucleotides that bind to each other with reduced stability. For example, an unstructured nucleic acid may contain a G' residue and a C' residue, where these residues correspond to non-naturally occurring forms, i.e., analogs, of G and C that base pair with each other with reduced stability, but retain an ability to base pair with naturally occurring C and G residues, respectively. Unstructured nucleic acid is described in US20050233340, which is incorporated by reference herein for disclosure of UNA.

The term "oligonucleotide" as used herein denotes a single-stranded multimer of nucleotides.

Unless otherwise indicated, nucleic acids are written left to right in 5' to 3' orientation; amino acid sequences are written left to right in amino to carboxy orientation, respectively.

The term "cleaving," as used herein, refers to a reaction that breaks the phosphodiester bonds between two adjacent nucleotides in both strands of a double-stranded DNA molecule, thereby resulting in a double-stranded break in the DNA molecule.

The term "nicking" as used herein, refers to a reaction that breaks the phosphodiester bond between two adjacent nucleotides in only one strand of a double-stranded DNA molecule, thereby resulting in a break in one strand of the DNA molecule.

The term "cleavage site, as used herein, refers to the site at which a double-stranded DNA molecule has been cleaved.

The "nucleic acid-guided nuclease-gNA complex" refers to a complex comprising a nucleic acid-guided nuclease protein and a guide nucleic acid (gNA, for example a gRNA or a gDNA). For example the "Cas9-gRNA complex" refers to a complex comprising a Cas9 protein and a guide RNA (gRNA). The nucleic acid-guided nuclease may be any type of nucleic acid-guided nuclease, including but not limited to wild type nucleic acid-guided nuclease, a catalytically dead nucleic acid-guided nuclease, or a nucleic acid-guided nuclease-nickase.

The term "nucleic acid-guided nuclease-associated guide NA" refers to a guide nucleic acid (guide NA). The nucleic acid-guided nuclease-associated guide NA may exist as an isolated nucleic acid, or as part of a nucleic acid-guided nuclease-gNA complex, for example a Cas9-gRNA complex.

The terms "capture" and "enrichment" are used interchangeably herein, and refer to the process of selectively isolating a nucleic acid region containing: sequences of interest, targeted sites of interest, sequences not of interest, or targeted sites not of interest.

The term "hybridization" refers to the process by which a strand of nucleic acid joins with a complementary strand through base pairing as known in the art. A nucleic acid is considered to be "selectively hybridizable" to a reference nucleic acid sequence if the two sequences specifically hybridize to one another under moderate to high stringency hybridization and wash conditions. Moderate and high stringency hybridization conditions are known (see, e.g., Ausubel, et al., Short Protocols in Molecular Biology, 3rd ed., Wiley & Sons 1995 and Sambrook et al., Molecular Cloning: A Laboratory Manual, Third Edition, 2001 Cold Spring Harbor, N.Y.). One example of high stringency conditions includes hybridization at about 42° C. in 50% formamide, 5×SSC, 5×Denhardt's solution, 0.5% SDS and 100 µg/ml denatured carrier DNA followed by washing two times in 2×SSC and 0.5% SDS at room temperature and two additional times in 0.1×SSC and 0.5% SDS at 42° C.

The term "duplex," or "duplexed," as used herein, describes two complementary polynucleotides that are base-paired, i.e., hybridized together.

The term "amplifying" as used herein refers to generating one or more copies of a target nucleic acid, using the target nucleic acid as a template.

The term "genomic region," as used herein, refers to a region of a genome, e.g., an animal or plant genome such as the genome of a human, monkey, rat, fish or insect or plant. In certain cases, an oligonucleotide used in the method described herein may be designed using a reference genomic region, i.e., a genomic region of known nucleotide sequence, e.g., a chromosomal region whose sequence is deposited at NCBI's Genbank database or other databases, for example.

The term "genomic sequence," as used herein, refers to a sequence that occurs in a genome. Because RNAs are transcribed from a genome, this term encompasses sequence that exist in the nuclear genome of an organism, as well as sequences that are present in a cDNA copy of an RNA (e.g., an mRNA) transcribed from such a genome.

The term "genomic fragment," as used herein, refers to a region of a genome, e.g., an animal or plant genome such as the genome of a human, monkey, rat, fish or insect or plant. A genomic fragment may be an entire chromosome, or a fragment of a chromosome. A genomic fragment may be adapter ligated (in which case it has an adapter ligated to one or both ends of the fragment, or to at least the 5' end of a molecule), or may not be adapter ligated.

In certain cases, an oligonucleotide used in the method described herein may be designed using a reference genomic region, i.e., a genomic region of known nucleotide sequence, e.g., a chromosomal region whose sequence is deposited at NCBI's Genbank database or other databases, for example Such an oligonucleotide may be employed in an assay that uses a sample containing a test genome, where the test genome contains a binding site for the oligonucleotide.

The term "ligating," as used herein, refers to the enzymatically catalyzed joining of the terminal nucleotide at the 5' end of a first DNA molecule to the terminal nucleotide at the 3' end of a second DNA molecule.

If two nucleic acids are "complementary," each base of one of the nucleic acids base pairs with corresponding nucleotides in the other nucleic acid. The term "complementary" and "perfectly complementary" are used synonymously herein.

The term "separating," as used herein, refers to physical separation of two elements (e.g., by size or affinity, etc.) as well as degradation of one element, leaving the other intact. For example, size exclusion can be employed to separate nucleic acids, including cleaved targeted sequences.

In a cell, DNA usually exists in a double-stranded form, and as such, has two complementary strands of nucleic acid referred to herein as the "top" and "bottom" strands. In certain cases, complementary strands of a chromosomal region may be referred to as "plus" and "minus" strands, the "first" and "second" strands, the "coding" and "noncoding" strands, the "Watson" and "Crick" strands or the "sense" and "antisense" strands. The assignment of a strand as being a top or bottom strand is arbitrary and does not imply any particular orientation, function or structure. Until they become covalently linked, the first and second strands are distinct molecules. For ease of description, the "top" and "bottom" strands of a double-stranded nucleic acid in which the top and bottom strands have been covalently linked will still be described as the "top" and "bottom" strands. In other words, for the purposes of this disclosure, the top and bottom strands of a double-stranded DNA do not need to be separated molecules. The nucleotide sequences of the first strand of several exemplary mammalian chromosomal regions (e.g., BACs, assemblies, chromosomes, etc.) is known, and may be found in NCBI's Genbank database, for example.

The term "top strand," as used herein, refers to either strand of a nucleic acid but not both strands of a nucleic acid. When an oligonucleotide or a primer binds or anneals "only to a top strand," it binds to only one strand but not the other. The term "bottom strand," as used herein, refers to the strand that is complementary to the "top strand." When an oligonucleotide binds or anneals "only to one strand," it binds to only one strand, e.g., the first or second strand, but not the other strand. If an oligonucleotide binds or anneals to both strands of a double-stranded DNA, the oligonucleotide may have two regions, a first region that hybridizes with the top strand of the double-stranded DNA, and a second region that hybridizes with the bottom strand of the double-stranded DNA.

The term "double-stranded DNA molecule" refers to both double-stranded DNA molecules in which the top and bottom strands are not covalently linked, as well as double-stranded DNA molecules in which the top and bottom stands are covalently linked. The top and bottom strands of a double-stranded DNA are base paired with one other by Watson-Crick interactions.

The term "denaturing," as used herein, refers to the separation of at least a portion of the base pairs of a nucleic acid duplex by placing the duplex in suitable denaturing conditions. Denaturing conditions are well known in the art. In one embodiment, in order to denature a nucleic acid duplex, the duplex may be exposed to a temperature that is above the $T_m$ of the duplex, thereby releasing one strand of the duplex from the other. In certain embodiments, a nucleic acid may be denatured by exposing it to a temperature of at least 90° C. for a suitable amount of time (e.g., at least 30 seconds, up to 30 mins). In certain embodiments, fully denaturing conditions may be used to completely separate the base pairs of the duplex. In other embodiments, partially denaturing conditions (e.g., with a lower temperature than fully denaturing conditions) may be used to separate the base pairs of certain parts of the duplex (e.g., regions enriched for A-T base pairs may separate while regions enriched for G-C base pairs may remain paired). Nucleic acid may also be denatured chemically (e.g., using urea or NaOH).

The term "genotyping," as used herein, refers to any type of analysis of a nucleic acid sequence, and includes sequencing, polymorphism (SNP) analysis, and analysis to identify rearrangements.

The term "sequencing," as used herein, refers to a method by which the identity of consecutive nucleotides of a polynucleotide are obtained.

The term "next-generation sequencing" refers to the so-called parallelized sequencing-by-synthesis or sequencing-by-ligation platforms, for example, those currently employed by Illumina, Life Technologies, and Roche, etc. Next-generation sequencing methods may also include nanopore sequencing methods or electronic-detection based methods such as Ion Torrent technology commercialized by Life Technologies.

The term "complementary DNA" or cDNA refers to a double-stranded DNA sample that was produced from an RNA sample by reverse transcription of RNA (using primers such as random hexamers or oligo-dT primers) followed by second-strand synthesis by digestion of the RNA with RNaseH and synthesis by DNA polymerase.

The term "RNA promoter adapter" is an adapter that contains a promoter for a bacteriophage RNA polymerase, e.g., the RNA polymerase from bacteriophage T3, T7, SP6 or the like.

Other definitions of terms may appear throughout the specification.

For any of the structural and functional characteristics described herein, methods of determining these characteristics are known in the art.

Guide Nucleic Acids (gNAs)

Provided herein are guide nucleic acids (gNAs) derivable from any nucleic acid source. The gNAs can be guide RNAs (gRNAs) or guide DNAs (gDNAs). The nucleic acid source can be DNA or RNA. Provided herein are methods to generate gNAs from any source nucleic acid, including DNA from a single organism, or mixtures of DNA from multiple organisms, or mixtures of DNA from multiple species, or DNA from clinical samples, or DNA from forensic samples, or DNA from environmental samples, or DNA from metagenomic DNA samples (for example a sample that contains more than one species of organism). Examples of any source DNA include, but are not limited to any genome, any genome fragment, cDNA, synthetic DNA, or a DNA collection (e.g. a SNP collection, DNA libraries). The gNAs provided herein can be used for genome-wide applications.

In some embodiments, the gNAs are derived from genomic sequences (e.g., genomic DNA). In some embodiments, the gNAs are derived from mammalian genomic sequences. In some embodiments, the gNAs are derived from eukaryotic genomic sequences. In some embodiments, the gNAs are derived from prokaryotic genomic sequences. In some embodiments, the gNAs are derived from viral genomic sequences. In some embodiments, the gNAs are derived from bacterial genomic sequences. In some embodiments, the gNAs are derived from plant genomic sequences. In some embodiments, the gNAs are derived from microbial genomic sequences. In some embodiments, the gNAs are derived from genomic sequences from a parasite, for example a eukaryotic parasite.

In some embodiments, the gNAs are derived from repetitive DNA. In some embodiments, the gNAs are derived from abundant DNA. In some embodiments, the gNAs are derived from mitochondrial DNA. In some embodiments, the gNAs are derived from ribosomal DNA. In some embodiments, the gNAs are derived from centromeric DNA. In some embodiments, the gNAs are derived from DNA comprising Alu elements (Alu DNA). In some embodiments, the gNAs are derived from DNA comprising long interspersed nuclear elements (LINE DNA). In some embodiments, the gNAs are derived from DNA comprising short interspersed nuclear elements (SINE DNA). In some embodiments the abundant DNA comprises ribosomal DNA. In some embodiments, the abundant DNA comprises host DNA (e.g., host genomic DNA or all host DNA). In an example, the gNAs can be derived from host DNA (e.g., human, animal, plant) for the depletion of host DNA to allow for easier analysis of other DNA that is present (e.g., bacterial, viral, or other metagenomic DNA). In another example, the gNAs can be derived from the one or more most abundant types (e.g., species) in a mixed sample, such as the one or more most abundant bacteria species in a metagenomic sample. The one or more most abundant types (e.g., species) can comprise the two, three, four, five, six, seven, eight, nine, ten, or more than ten most abundant types (e.g., species). The most abundant types can be the most abundant kingdoms, phyla or divisions, classes, orders, families, genuses, species, or other classifications. The most abundant types can be the most abundant cell types, such as epithelial cells, bone cells, muscle cells, blood cells, adipose cells, or other cell types. The most abundant types can be non-cancerous cells. The most abundant types can be cancerous cells. The most abundant types can be animal, human, plant, fungal, bacterial, or viral. gNAs can be derived from both a host and the one or more most abundant non-host types (e.g., species) in a sample, such as from both human DNA and the DNA of the one or more most abundant bacterial species. In some embodiments, the abundant DNA comprises DNA from the more abundant or most abundant cells in a sample. For example, for a specific sample, the highly abundant cells can be extracted and their DNA can be used to produce gNAs; these gNAs can be used to produce depletion library and applied to original sample to enable or enhance sequencing or detection of low abundance targets.

In some embodiments, the gNAs are derived from DNA comprising short terminal repeats (STRs).

In some embodiments, the gNAs are derived from a genomic fragment, comprising a region of the genome, or the whole genome itself. In one embodiment, the genome is a DNA genome. In another embodiment, the genome is a RNA genome.

In some embodiments, the gNAs are derived from a eukaryotic or prokaryotic organism; from a mammalian organism or a non-mammalian organism; from an animal or a plant; from a bacteria or virus; from an animal parasite; from a pathogen.

In some embodiments, the gNAs are derived from any mammalian organism. In one embodiment the mammal is a human. In another embodiment the mammal is a livestock animal, for example a horse, a sheep, a cow, a pig, or a donkey. In another embodiment, a mammalian organism is a domestic pet, for example a cat, a dog, a gerbil, a mouse, a rat. In another embodiment the mammal is a type of a monkey.

In some embodiments, the gNAs are derived from any bird or avian organism. An avian organism includes but is not limited to chicken, turkey, duck and goose.

In some embodiments, the gNAs are derived from a plant. In one embodiment, the plant is rice, maize, wheat, rose, grape, coffee, fruit, tomato, potato, or cotton.

In some embodiments, the gNAs are derived from a species of bacteria. In one embodiment, the bacteria are tuberculosis-causing bacteria.

In some embodiments, the gNAs are derived from a virus.

In some embodiments, the gNAs are derived from a species of fungi.

In some embodiments, the gNAs are derived from a species of algae.

In some embodiments, the gNAs are derived from any mammalian parasite.

In some embodiments, the gNAs are derived from any mammalian parasite. In one embodiment, the parasite is a worm. In another embodiment, the parasite is a malaria-causing parasite. In another embodiment, the parasite is a Leishmaniasis-causing parasite. In another embodiment, the parasite is an amoeba.

In some embodiments, the gNAs are derived from a nucleic acid target. Contemplated targets include, but are not limited to, pathogens; single nucleotide polymorphisms (SNPs), insertions, deletions, tandem repeats, or translocations; human SNPs or STRs; potential toxins; or animals, fungi, and plants. In some embodiments, the gRNAs are derived from pathogens, and are pathogen-specific gNAs.

In some embodiments, a guide NA of the invention comprises a first NA segment comprising a targeting sequence, wherein the targeting sequence is 15-250 bp; and a second NA segment comprising a nucleic acid guided nuclease system (e.g., CRISPR/Cas system) protein-binding sequence. In some embodiments, the targeting sequence is greater than 21 bp, greater than 22 bp, greater than 23 bp, greater than 24 bp, greater than 25 bp, greater than 26 bp, greater than 27 bp, greater than 28 bp, greater than 29 bp, greater than 30 bp, greater than 40 bp, greater than 50 bp, greater than 60 bp, greater than 70 bp, greater than 80 bp, greater than 90 bp, greater than 100 bp, greater than 110 bp, greater than 120 bp, greater than 130 bp, greater than 140 bp, or even greater than 150 bp. In an exemplary embodiment, the targeting sequence is greater than 30 bp. In some embodiments, the targeting sequences of the present invention range in size from 30-50 bp. In some embodiments, targeting sequences of the present invention range in size from 30-75 bp. In some embodiments, targeting sequences of the present invention range in size from 30-100 bp. For example, a targeting sequence can be at least 15 bp, 20 bp, 25 bp, 30 bp, 35 bp, 40 bp, 45 bp, 50 bp, 55 bp, 60 bp, 65 bp, 70 bp, 75 bp, 80 bp, 85 bp, 90 bp, 95 bp, 100 bp, 110 bp, 120 bp, 130 bp, 140 bp, 150 bp, 160 bp, 170 bp, 180 bp, 190 bp, 200 bp, 210 bp, 220 bp, 230 bp, 240 bp, or 250 bp. In specific embodiments, the targeting sequence is at least 22 bp. In specific embodiments, the targeting sequence is at least 30 bp.

In some embodiments, target-specific gNAs can comprise a nucleic acid sequence that is complementary to a region on the opposite strand of the targeted nucleic acid sequence 5' to a PAM sequence, which can be recognized by a nucleic acid-guided nuclease system (e.g., CRISPR/Cas system) protein. In some embodiments the targeted nucleic acid sequence is immediately 5' to a PAM sequence. In specific embodiments, the nucleic acid sequence of the gNA that is complementary to a region in a target nucleic acid is 15-250 bp. In specific embodiments, the nucleic acid sequence of the gNA that is complementary to a region in a target nucleic acid is 22, 23, 24, 25, 30, 35, 40, 45, 50, 60, 70, 75, 80, 90, or 100 bp.

In some particular embodiments, the targeting sequence is not 20 bp. In some particular embodiments, the targeting sequence is not 21 bp.

In some embodiments, the gNAs comprise any purines or pyrimidines (and/or modified versions of the same). In some embodiments, the gNAs comprise adenine, uracil, guanine, and cytosine (and/or modified versions of the same). In some embodiments, the gNAs comprise adenine, thymine, guanine, and cytosine (and/or modified versions of the same). In some embodiments, the gNAs comprise adenine, thymine, guanine, cytosine and uracil (and/or modified versions of the same).

In some embodiments, the gNAs comprise a label, are attached to a label, or are capable of being labeled. In some embodiments, the gNA comprises is a moiety that is further capable of being attached to a label. A label includes, but is not limited to, enzyme, an enzyme substrate, an antibody, an antigen binding fragment, a peptide, a chromophore, a lumiphore, a fluorophore, a chromogen, a hapten, an antigen, a radioactive isotope, a magnetic particle, a metal nanoparticle, a redox active marker group (capable of undergoing a redox reaction), an aptamer, one member of a binding pair, a member of a FRET pair (either a donor or acceptor fluorophore), and combinations thereof.

In some embodiments, the gNAs are attached to a substrate. The substrate can be made of glass, plastic, silicon, silica-based materials, functionalized polystyrene, functionalized polyethyleneglycol, functionalized organic polymers, nitrocellulose or nylon membranes, paper, cotton, and materials suitable for synthesis. Substrates need not be flat. In some embodiments, the substrate is a 2-dimensional array. In some embodiments, the 2-dimensional array is flat. In some embodiments, the 2-dimensional array is not flat, for example, the array is a wave-like array. Substrates include any type of shape including spherical shapes (e.g., beads). Materials attached to substrates may be attached to any portion of the substrates (e.g., may be attached to an interior portion of a porous substrates material). In some embodiments, the substrate is a 3-dimensional array, for example, a microsphere. In some embodiments, the microsphere is magnetic. In some embodiments, the microsphere is glass. In some embodiments, the microsphere is made of polystyrene. In some embodiments, the microsphere is silica-based. In some embodiments, the substrate is an array with interior surface, for example, is a straw, tube, capillary, cylindrical, or microfluidic chamber array. In some embodiments, the substrate comprises multiple straws, capillaries, tubes, cylinders, or chambers.

Nucleic Acids Encoding gNAs

Also provided herein are nucleic acids encoding for gNAs (e.g., gRNAs or gDNAs). In some embodiments, by encoding it is meant that a gNA results from the transcription of a nucleic acid encoding for a gNA (e.g., gRNA). In some embodiments, by encoding, it is meant that the nucleic acid is a template for the transcription of a gNA (e.g., gRNA). In some embodiments, by encoding, it is meant that a gNA results from the reverse transcription of a nucleic acid encoding for a gNA. In some embodiments, by encoding, it is meant that the nucleic acid is a template for the reverse transcription of a gNA. In some embodiments, by encoding, it is meant that a gNA results from the amplification of a nucleic acid encoding for a gNA. In some embodiments, by encoding, it is meant that the nucleic acid is a template for the amplification of a gNA.

In some embodiments the nucleic acid encoding for a gNA comprises a first segment comprising a regulatory region; a second segment comprising targeting sequence, wherein the second segment can range from 15 bp-250 bp; and a third segment comprising a nucleic acid encoding a nucleic acid-guided nuclease system (e.g., CRISPR/Cas system) protein-binding sequence.

In some embodiments, the nucleic acids encoding for gNAs comprise DNA. In some embodiments, the first segment is double stranded DNA. In some embodiments, the first segment is single stranded DNA. In some embodiments, the second segment is single stranded DNA. In some embodiments, the third segment is single stranded DNA. In some embodiments, the second segment is double stranded DNA. In some embodiments, the third segment is double stranded DNA.

In some embodiments, the nucleic acids encoding for gNAs comprise RNA.

In some embodiments the nucleic acids encoding for gNAs comprise DNA and RNA.

In some embodiments, the regulatory region is a region capable of binding a transcription factor. In some embodiments, the regulatory region comprises a promoter. In some embodiments, the promoter is selected from the group consisting of T7, SP6, and T3.

Collections of gNAs

Provided herein are collections (interchangeably referred to as libraries) of gNAs.

As used herein, a collection of gNAs denotes a mixture of gNAs containing at least $10^2$ unique gNAs. In some embodiments a collection of gNAs contains at least $10^2$, at least $10^3$, at least $10^4$, at least $10^5$, at least $10^6$, at least $10^7$, at least $10^8$, at least $10^9$, at least $10^{10}$ unique gNAs. In some embodiments a collection of gNAs contains a total of at least $10^2$, at least $10^3$, at least $10^4$, at least $10^5$, at least $10^6$, at least $10^7$, at least $10^8$, at least $10^9$, at least $10^{10}$ gNAs.

In some embodiments, a collection of gNAs comprises a first NA segment comprising a targeting sequence; and a second NA segment comprising a nucleic acid-guided nuclease system (e.g., CRISPR/Cas system) protein-binding sequence, wherein at least 10% of the gNAs in the collection vary in size. In some embodiments, the first and second segments are in 5'- to 3'-order'.

In some embodiments, the size of the first segment varies from 15-250 bp, or 30-100 bp, or 22-30 bp, or 15-50 bp, or 15-75 bp, or 15-100 bp, or 15-125 bp, or 15-150 bp, or 15-175 bp, or 15-200 bp, or 15-225 bp, or 15-250 bp, or 22-50 bp, or 22-75 bp, or 22-100 bp, or 22-125 bp, or 22-150 bp, or 22-175 bp, or 22-200 bp, or 22-225 bp, or 22-250 bp across the collection of gNAs.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the first segments in the collection are greater than 21 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the first segments in the collection are greater than 25 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the first segments in the collection are greater than 30 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the first segments in the collection are 15-50 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the first segments in the collection are 30-100 bp.

In some particular embodiments, the size of the first segment is not 20 bp.

In some particular embodiments, the size of the first segment is not 21 bp.

In some embodiments, the gNAs and/or the targeting sequence of the gNAs in the collection of gRNAs comprise unique 5' ends. In some embodiments, the collection of gNAs exhibit variability in sequence of the 5' end of the targeting sequence, across the members of the collection. In some embodiments, the collection of gNAs exhibit variability at least 5%, or at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75% variability in the sequence of the 5' end of the targeting sequence, across the members of the collection.

In some embodiments, the 3' end of the gNA targeting sequence can be any purine or pyrimidine (and/or modified versions of the same). In some embodiments, the 3' end of the gNA targeting sequence is an adenine. In some embodiments, the 3' end of the gNA targeting sequence is a guanine. In some embodiments, the 3' end of the gNA targeting sequence is a cytosine. In some embodiments, the 3' end of the gNA targeting sequence is a uracil. In some embodiments, the 3' end of the gNA targeting sequence is a thymine. In some embodiments, the 3' end of the gNA targeting sequence is not cytosine.

In some embodiments, the collection of gNAs comprises targeting sequences which can base-pair with the targeted DNA, wherein the target of interest is spaced at least every 1 bp, at least every 2 bp, at least every 3 bp, at least every 4 bp, at least every 5 bp, at least every 6 bp, at least every 7 bp, at least every 8 bp, at least every 9 bp, at least every 10 bp, at least every 11 bp, at least every 12 bp, at least every 13 bp, at least every 14 bp, at least every 15 bp, at least every 16 bp, at least every 17 bp, at least every 18 bp, at least every 19 bp, 20 bp, at least every 25 bp, at least every 30 bp, at least every 40 bp, at least every 50 bp, at least every 100 bp, at least every 200 bp, at least every 300 bp, at least every 400 bp, at least every 500 bp, at least every 600 bp, at least every 700 bp, at least every 800 bp, at least every 900 bp, at least every 1000 bp, at least every 2500 bp, at least every 5000 bp, at least every 10,000 bp, at least every 15,000 bp, at least every 20,000 bp, at least every 25,000 bp, at least every 50,000 bp, at least every 100,000 bp, at least every 250,000 bp, at least every 500,000 bp, at least every 750,000 bp, or even at least every 1,000,000 bp across a genome of interest.

In some embodiments, the collection of gNAs comprises a first NA segment comprising a targeting sequence; and a second NA segment comprising a nucleic acid-guided nuclease system (e.g., CRISPR/Cas system) protein-binding sequence, wherein the gNAs in the collection can have a variety of second NA segments with various specificities for protein members of the nucleic acid-guided nuclease system (e.g., CRISPR/Cas system). For example a collection of gNAs as provided herein, can comprise members whose second segment comprises a nucleic acid-guided nuclease system (e.g., CRISPR/Cas system) protein-binding sequence specific for a first nucleic acid-guided nuclease system (e.g., CRISPR/Cas system) protein; and also comprises members whose second segment comprises a nucleic acid-guided nuclease system (e.g., CRISPR/Cas system) protein-binding sequence specific for a second nucleic acid-guided nuclease system (e.g., CRISPR/Cas system) protein, wherein the first and second nucleic acid-guided nuclease system (e.g., CRISPR/Cas system) proteins are not the same. In some embodiments a collection of gNAs as provided herein comprises members that exhibit specificity to at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, or even at least 20 nucleic acid-guided nuclease system (e.g., CRISPR/Cas system) proteins. In one specific embodiment, a collection of gNAs as provided herein comprises members that exhibit specificity for a Cas9 protein and another protein selected from the group consisting of Cpf1, Cas3, Cas8a-c, Cas10, Cse1, Csy1, Csn2, Cas4, Csm2, and Cm5.

In some embodiments, a plurality of the gNA members of the collection are attached to a label, comprise a label or are capable of being labeled. In some embodiments, the gNA comprises is a moiety that is further capable of being attached to a label. A label includes, but is not limited to, enzyme, an enzyme substrate, an antibody, an antigen binding fragment, a peptide, a chromophore, a lumiphore, a fluorophore, a chromogen, a hapten, an antigen, a radioactive isotope, a magnetic particle, a metal nanoparticle, a redox active marker group (capable of undergoing a redox reaction), an aptamer, one member of a binding pair, a member of a FRET pair (either a donor or acceptor fluorophore), and combinations thereof.

In some embodiments, a plurality of the gNA members of the collection are attached to a substrate. The substrate can be made of glass, plastic, silicon, silica-based materials, functionalized polystyrene, functionalized polyethyleneglycol, functionalized organic polymers, nitrocellulose or nylon membranes, paper, cotton, and materials suitable for synthesis. Substrates need not be flat. In some embodiments, the substrate is a 2-dimensional array. In some embodiments, the 2-dimensional array is flat. In some embodiments, the 2-dimensional array is not flat, for example, the array is a wave-like array. Substrates include any type of shape including spherical shapes (e.g., beads). Materials attached to substrates may be attached to any portion of the substrates (e.g., may be attached to an interior portion of a porous substrates material). In some embodiments, the substrate is a 3-dimensional array, for example, a microsphere. In some embodiments, the microsphere is magnetic. In some embodiments, the microsphere is glass. In some embodiments, the microsphere is made of polystyrene. In some embodiments, the microsphere is silica-based. In some embodiments, the substrate is an array with interior surface, for example, is a straw, tube, capillary, cylindrical, or microfluidic chamber array. In some embodiments, the substrate comprises multiple straws, capillaries, tubes, cylinders, or chambers.

Collections of Nucleic Acids Encoding gNAs

Provided herein are collections (interchangeably referred to as libraries) of nucleic acids encoding for gNAs (e.g., gRNAs or gDNAs). In some embodiments, by encoding it is meant that a gNA results from the transcription of a nucleic acid encoding for a gNA. In some embodiments, by encoding, it is meant that the nucleic acid is a template for the transcription of a gNA.

As used herein, a collection of nucleic acids encoding for gNAs denotes a mixture of nucleic acids containing at least $10^2$ unique nucleic acids. In some embodiments a collection of nucleic acids encoding for gNAs contains at least $10^2$, at least $10^3$, at least $10^4$, at least $10^5$, at least $10^6$, at least $10^7$, at least $10^8$, at least $10^9$, at least $10^{10}$ unique nucleic acids encoding for gNAs. In some embodiments a collection of nucleic acids encoding for gNAs contains a total of at least $10^2$, at least $10^3$, at least $10^4$, at least $10^5$, at least $10^6$, at least $10^7$, at least $10^8$, at least $10^9$, at least $10^{10}$ nucleic acids encoding for gNAs.

In some embodiments, a collection of nucleic acids encoding for gNAs comprises a first segment comprising a regulatory region; a second segment comprising a targeting sequence; and a third segment comprising a nucleic acid encoding a nucleic acid-guided nuclease system (e.g., CRISPR/Cas system) protein-binding sequence, wherein at least 10% of the nucleic acids in the collection vary in size.

In some embodiments, the first, second, and third segments are in 5'- to 3'-order'.

In some embodiments, the nucleic acids encoding for gNAs comprise DNA. In some embodiments, the first segment is single stranded DNA. In some embodiments, the first segment is double stranded DNA. In some embodiments, the second segment is single stranded DNA. In some embodiments, the third segment is single stranded DNA. In some embodiments, the second segment is double stranded DNA. In some embodiments, the third segment is double stranded DNA.

In some embodiments, the nucleic acids encoding for gNAs comprise RNA.

In some embodiments the nucleic acids encoding for gNAs comprise DNA and RNA.

In some embodiments, the regulatory region is a region capable of binding a transcription factor. In some embodiments, the regulatory region comprises a promoter. In some embodiments, the promoter is selected from the group consisting of T7, SP6, and T3.

In some embodiments, the size of the second segments (targeting sequence) in the collection varies from 15-250 bp, or 30-100 bp, or 22-30 bp, or 15-50 bp, or 15-75 bp, or 15-100 bp, or 15-125 bp, or 15-150 bp, or 15-175 bp, or 15-200 bp, or 15-225 bp, or 15-250 bp, or 22-50 bp, or 22-75 bp, or 22-100 bp, or 22-125 bp, or 22-150 bp, or 22-175 bp, or 22-200 bp, or 22-225 bp, or 22-250 bp across the collection of gNAs.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the second segments in the collection are greater than 21 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the second segments in the collection are greater than 25 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the second segments in the collection are greater than 30 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the second segments in the collection are 15-50 bp.

In some embodiments, at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100% of the second segments in the collection are 30-100 bp.

In some particular embodiments, the size of the second segment is not 20 bp.

In some particular embodiments, the size of the second segment is not 21 bp.

In some embodiments, the gNAs and/or the targeting sequence of the gNAs in the collection of gNAs comprise unique 5' ends. In some embodiments, the collection of gNAs exhibit variability in sequence of the 5' end of the targeting sequence, across the members of the collection. In some embodiments, the collection of gNAs exhibit variability at least 5%, or at least 10%, or at least 15%, or at last 20%, or at least 25%, or at least 30%, or at least 35%, or at least 40%, or at least 45%, or at least 50%, or at least 55%, or at least 60%, or at least 65%, or at least 70%, or at least 75% variability in the sequence of the 5' end of the targeting sequence, across the members of the collection.

In some embodiments, the collection of nucleic acids comprises targeting sequences, wherein the target of interest is spaced at least every 1 bp, at least every 2 bp, at least every 3 bp, at least every 4 bp, at least every 5 bp, at least every 6 bp, at least every 7 bp, at least every 8 bp, at least every 9 bp, at least every 10 bp, at least every 11 bp, at least every 12 bp, at least every 13 bp, at least every 14 bp, at least every 15 bp, at least every 16 bp, at least every 17 bp, at least every 18 bp, at least every 19 bp, 20 bp, at least every 25 bp, at least every 30 bp, at least every 40 bp, at least every 50 bp, at least every 100 bp, at least every 200 bp, at least every 300 bp, at least every 400 bp, at least every 500 bp, at least every 600 bp, at least every 700 bp, at least every 800 bp, at least every 900 bp, at least every 1000 bp, at least every 2500 bp, at least every 5000 bp, at least every 10,000 bp, at least every 15,000 bp, at least every 20,000 bp, at least every 25,000 bp, at least every 50,000 bp, at least every 100,000 bp, at least every 250,000 bp, at least every 500,000 bp, at least every 750,000 bp, or even at least every 1,000,000 bp across a genome of interest.

In some embodiments, the collection of nucleic acids encoding for gNAs comprise a third segment encoding for a nucleic acid-guided nuclease system (e.g., CRISPR/Cas system) protein-binding sequence, wherein the segments in the collection vary in their specificity for protein members of the nucleic acid-guided nuclease system (e.g., CRISPR/Cas system). For example, a collection of nucleic acids encoding for gNAs as provided herein, can comprise members whose third segment encode for a nucleic acid-guided nuclease system (e.g., CRISPR/Cas system) protein-binding sequence specific for a first nucleic acid-guided nuclease system (e.g., CRISPR/Cas system) protein; and also comprises members whose third segment encodes for a nucleic acid-guided nuclease system (e.g., CRISPR/Cas system) protein-binding sequence specific for a second nucleic acid-guided nuclease system (e.g., CRISPR/Cas system) protein, wherein the first and second nucleic acid-guided nuclease system (e.g., CRISPR/Cas system) proteins are not the same. In some embodiments, a collection of nucleic acids encoding for gNAs as provided herein comprises members that exhibit specificity to at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, or even at least 20 nucleic acid-guided nuclease system (e.g., CRISPR/Cas system) proteins. In one specific embodiment, a collection of nucleic acids encoding for gNAs as provided herein comprises members that exhibit specificity for a Cas9 protein and another protein selected from the group consisting of Cpf1, Cas3, Cas8a-c, Cas10, Cse1, Csy1, Csn2, Cas4, Csm2, and Cm5.

Sequences of Interest

Provided herein are gNAs and collections of gNAs, derived from any source DNA (for example from genomic DNA, cDNA, artificial DNA, DNA libraries), that can be used to target sequences of interest in a sample for a variety of applications including, but not limited to, enrichment, depletion, capture, partitioning, labeling, regulation, and editing. The gNAs comprise a targeting sequence, directed at sequences of interest.

In some embodiments, the sequences of interest are genomic sequences (genomic DNA). In some embodiments, the sequences of interest are mammalian genomic sequences. In some embodiments, the sequences of interest are eukaryotic genomic sequences. In some embodiments, the sequences of interest are prokaryotic genomic sequences. In some embodiments, the sequences of interest are viral genomic sequences. In some embodiments, the sequences of interest are bacterial genomic sequences. In some embodiments, the sequences of interest are plant genomic sequences. In some embodiments, the sequences of interest are microbial genomic sequences. In some embodiments, the sequences of interest are genomic sequences from a parasite, for example a eukaryotic parasite. In some embodiments, the sequences of interest are host genomic sequences (e.g., the host organism of a microbiome, a parasite, or a pathogen). In some embodiments, the sequences of interest are abundant genomic sequences, such as sequences from the genome or genomes of the most abundant species in a sample.

In some embodiments, the sequences of interest comprise repetitive DNA. In some embodiments, the sequences of interest comprise abundant DNA. In some embodiments, the sequences of interest comprise mitochondrial DNA. In some embodiments, the sequences of interest comprise ribosomal DNA. In some embodiments, the sequences of interest comprise centromeric DNA. In some embodiments, the sequences of interest comprise DNA comprising Alu elements (Alu DNA). In some embodiments, the sequences of interest comprise long interspersed nuclear elements (LINE DNA). In some embodiments, the sequences of interest comprise short interspersed nuclear elements (SINE DNA). In some embodiments, the abundant DNA comprises ribosomal DNA.

In some embodiments, the sequences of interest comprise single nucleotide polymorphisms (SNPs), short tandem repeats (STRs), cancer genes, inserts, deletions, structural variations, exons, genetic mutations, or regulatory regions.

In some embodiments, the sequences of interest can be a genomic fragment, comprising a region of the genome, or the whole genome itself. In one embodiment, the genome is a DNA genome. In another embodiment, the genome is a RNA genome.

In some embodiments, the sequences of interest are from a eukaryotic or prokaryotic organism; from a mammalian organism or a non-mammalian organism; from an animal or a plant; from a bacteria or virus; from an animal parasite; from a pathogen.

In some embodiments, the sequences of interest are from any mammalian organism. In one embodiment the mammal is a human. In another embodiment the mammal is a livestock animal, for example a horse, a sheep, a cow, a pig, or a donkey. In another embodiment, a mammalian organism is a domestic pet, for example a cat, a dog, a gerbil, a mouse, a rat. In another embodiment the mammal is a type of a monkey.

In some embodiments, the sequences of interest are from any bird or avian organism. An avian organism includes but is not limited to chicken, turkey, duck and goose.

In some embodiments, the sequences of interest are from a plant. In one embodiment, the plant is rice, maize, wheat, rose, grape, coffee, fruit, tomato, potato, or cotton.

In some embodiments, the sequences of interest are from a species of bacteria. In one embodiment, the bacteria are tuberculosis-causing bacteria.

In some embodiments, the sequences of interest are from a virus.

In some embodiments, the sequences of interest are from a species of fungi.

In some embodiments, the sequences of interest are from a species of algae.

In some embodiments, the sequences of interest are from any mammalian parasite.

In some embodiments, the sequences of interest are obtained from any mammalian parasite. In one embodiment, the parasite is a worm. In another embodiment, the parasite is a malaria-causing parasite. In another embodiment, the parasite is a Leishmaniasis-causing parasite. In another embodiment, the parasite is an amoeba.

In some embodiments, the sequences of interest are from a pathogen.

Targeting Sequences

As used herein, a targeting sequence is one that directs the gNA to the sequences of interest in a sample. For example, a targeting sequence targets a particular sequence of interest, for example the targeting sequence targets a genomic sequence of interest.

Provided herein are gNAs and collections of gNAs that comprise a segment that comprises a targeting sequence. Also provided herein, are nucleic acids encoding for gNAs, and collections of nucleic acids encoding for gNAs that comprise a segment encoding for a targeting sequence.

In some embodiments, the targeting sequence comprises DNA.

In some embodiments, the targeting sequence comprises RNA.

In some embodiments, the targeting sequence comprises RNA, and shares at least 70% sequence identity, at least 75% sequence identity, at least 80% sequence identity, at least 85% sequence identity, at least 90% sequence identity, at least 95% sequence identity, or shares 100% sequence identity to a sequence 5' to a PAM sequence on a sequence of interest, except that the RNA comprises uracils instead of thymines. In some embodiments, the PAM sequence is AGG, CGG, or TGG.

In some embodiments, the targeting sequence comprises DNA, and shares at least 70% sequence identity, at least 75% sequence identity, at least 80% sequence identity, at least 85% sequence identity, at least 90% sequence identity, at least 95% sequence identity, or shares 100% sequence identity to a sequence 5' to a PAM sequence on a sequence of interest.

In some embodiments, the targeting sequence comprises RNA and is complementary to the strand opposite to a sequence of nucleotides 5' to a PAM sequence. In some embodiments, the targeting sequence is at least 70% complementary, at least 75% complementary, at least 80% complementary, at least 85% complementary, at least 90% complementary, at least 95% complementary, or is 100% complementary to the strand opposite to a sequence of nucleotides 5' to a PAM sequence. In some embodiments, the PAM sequence is AGG, CGG, or TGG.

In some embodiments, the targeting sequence comprises DNA and is complementary to the strand opposite to a sequence of nucleotides 5' to a PAM sequence. In some embodiments, the targeting sequence is at least 70% complementary, at least 75% complementary, at least 80% complementary, at least 85% complementary, at least 90% complementary, at least 95% complementary, or is 100% complementary to the strand opposite to a sequence of nucleotides 5' to a PAM sequence. In some embodiments, the PAM sequence is AGG, CGG, or TGG.

In some embodiments, a DNA encoding for a targeting sequence of a gRNA shares at least 70% sequence identity, at least 75% sequence identity, at least 80% sequence identity, at least 85% sequence identity, at least 90% sequence identity, at least 95% sequence identity, or shares 100% sequence identity to the strand opposite to a sequence of nucleotides 5' to a PAM sequence. In some embodiments, the PAM sequence is AGG, CGG, or TGG.

In some embodiments, a DNA encoding for a targeting sequence of a gRNA is complementary to the strand opposite to a sequence of nucleotides 5' to a PAM sequence and is at least 70% complementary, at least 75% complementary, at least 80% complementary, at least 85% complementary, at least 90% complementary, at least 95% complementary, or is 100% complementary to a sequence 5' to a PAM sequence on a sequence of interest. In some embodiments, the PAM sequence is AGG, CGG, or TGG.

Nucleic Acid-Guided Nuclease System Proteins

Provided herein are gNAs and collections of gNAs comprising a segment that comprises a nucleic acid-guided nuclease system (e.g., CRISPR/Cas system) protein-binding sequence. Also provided herein, are nucleic acids encoding for gNAs, and collections of nucleic acids encoding for gNAs that comprise a segment encoding a nucleic acid-guided nuclease system (e.g., CRISPR/Cas system) protein-binding sequence. A nucleic acid-guided nuclease system can be an RNA-guided nuclease system. A nucleic acid-guided nuclease system can be a DNA-guided nuclease system.

Methods of the present disclosure can utilize nucleic acid-guided nucleases. As used herein, a "nucleic acid-guided nuclease" is any nuclease that cleaves DNA, RNA or DNA/RNA hybrids, and which uses one or more nucleic acid guide nucleic acids (gNAs) to confer specificity. Nucleic acid-guided nucleases include CRISPR/Cas system proteins as well as non-CRISPR/Cas system proteins.

The nucleic acid-guided nucleases provided herein can be DNA guided DNA nucleases; DNA guided RNA nucleases; RNA guided DNA nucleases; or RNA guided RNA nucleases. The nucleases can be endonucleases. The nucleases can be exonucleases. In one embodiment, the nucleic acid-guided nuclease is a nucleic acid-guided-DNA endonuclease. In one embodiment, the nucleic acid-guided nuclease is a nucleic acid-guided-RNA endonuclease.

A nucleic acid-guided nuclease system protein-binding sequence is a nucleic acid sequence that binds any protein member of a nucleic acid-guided nuclease system. For example, a CRISPR/Cas system protein-binding sequence is a nucleic acid sequence that binds any protein member of a CRISPR/Cas system.

In some embodiments, the nucleic acid-guided nuclease is selected from the group consisting of CAS Class I Type I, CAS Class I Type III, CAS Class I Type IV, CAS Class II Type II, and CAS Class II Type V. In some embodiments, CRISPR/Cas system proteins include proteins from CRISPR Type I systems, CRISPR Type II systems, and CRISPR Type III systems. In some embodiments, the nucleic acid-guided nuclease is selected from the group consisting of Cas9, Cpf1, Cas3, Cas8a-c, Cas10, Cse1, Csy1, Csn2, Cas4, Csm2, Cm5, Csf1, C2c2, and NgAgo.

In some embodiments, nucleic acid-guided nuclease system proteins (e.g., CRISPR/Cas system proteins) can be from any bacterial or archaeal species.

In some embodiments, the nucleic acid-guided nuclease system proteins (e.g., CRISPR/Cas system proteins) are from, or are derived from nucleic acid-guided nuclease system proteins (e.g., CRISPR/Cas system proteins) from *Streptococcus pyogenes, Staphylococcus aureus, Neisseria meningitidis, Streptococcus thermophiles, Treponema denticola, Francisella tularensis, Pasteurella multocida, Campylobacter jejuni, Campylobacter lari, Mycoplasma gallisepticum, Nitratifractor salsuginis, Parvibaculum lavamentivorans, Roseburia intestinalis, Neisseria cinerea, Gluconacetobacter diazotrophicus, Azospirillum, Sphaerochaeta globus, Flavobacterium columnare, Fluviicola taffensis, Bacteroides coprophilus, Mycoplasma mobile, Lactobacillus farciminis, Streptococcus pasteurianus, Lactobacillus johnsonii, Staphylococcus pseudintermedius,* *Filifactor alocis, Legionella pneumophila, Suterella wadsworthensis,* or *Corynebacter diphtheria.*

In some embodiments, examples of nucleic acid-guided nuclease system (e.g., CRISPR/Cas system) proteins can be naturally occurring or engineered versions.

In some embodiments, naturally occurring nucleic acid-guided nuclease system (e.g., CRISPR/Cas system) proteins include Cas9, Cpf1, Cas3, Cas8a-c, Cas10, Cse1, Csy1, Csn2, Cas4, Csm2, and Cm5. Engineered versions of such proteins can also be employed.

In some embodiments, engineered examples of nucleic acid-guided nuclease system (e.g., CRISPR/Cas system) proteins include catalytically dead nucleic acid-guided nuclease system proteins. The term "catalytically dead" generally refers to a nucleic acid-guided nuclease system protein that has inactivated nucleases (e.g., HNH and RuvC nucleases). Such a protein can bind to a target site in any nucleic acid (where the target site is determined by the guide NA), but the protein is unable to cleave or nick the target nucleic acid (e.g., double-stranded DNA). In some embodiments, the nucleic acid-guided nuclease system catalytically dead protein is a catalytically dead CRISPR/Cas system protein, such as catalytically dead Cas9 (dCas9). Accordingly, the dCas9 allows separation of the mixture into unbound nucleic acids and dCas9-bound fragments. In one embodiment, a dCas9/gRNA complex binds to targets determined by the gRNA sequence. The dCas9 bound can prevent cutting by Cas9 while other manipulations proceed. In another embodiment, the dCas9 can be fused to another enzyme, such as a transposase, to target that enzyme's activity to a specific site. Naturally occurring catalytically dead nucleic acid-guided nuclease system proteins can also be employed.

In some embodiments, engineered examples of nucleic acid-guided nuclease (e.g., CRISPR/Cas) system proteins also include nucleic acid-guided nickases (e.g., Cas nickases). A nucleic acid-guided nickase refers to a modified version of a nucleic acid-guided nuclease system protein, containing a single inactive catalytic domain. In one embodiment, the nucleic acid-guided nickase is a Cas nickase, such as Cas9 nickase. A Cas9 nickase may contain a single inactive catalytic domain, for example, either the RuvC- or the HNH-domain. With only one active nuclease domain, the Cas9 nickase cuts only one strand of the target DNA, creating a single-strand break or "nick". Depending on which mutant is used, the guide NA-hybridized strand or the non-hybridized strand may be cleaved. Nucleic acid-guided nickases bound to 2 gNAs that target opposite strands will create a double-strand break in a target double-stranded DNA. This "dual nickase" strategy can increase the specificity of cutting because it requires that both nucleic acid-guided nuclease/gNA (e.g., Cas9/gRNA) complexes be specifically bound at a site before a double-strand break is formed. Naturally occurring nickase nucleic acid-guided nuclease system proteins can also be employed.

In some embodiments, engineered examples of nucleic acid-guided nuclease system proteins also include nucleic acid-guided nuclease system fusion proteins. For example, a nucleic acid-guided nuclease (e.g., CRISPR/Cas) system protein may be fused to another protein, for example an activator, a repressor, a nuclease, a fluorescent molecule, a radioactive tag, or a transposase.

In some embodiments, the nucleic acid-guided nuclease system protein-binding sequence comprises a gNA (e.g., gRNA) stem-loop sequence.

In some embodiments, a double-stranded DNA sequence encoding the gNA (e.g., gRNA) stem-loop sequence comprises the following DNA sequence on one strand (5'>3', GTTTTAGAGCTAGAAATAGCAAGT-TAAAATAAGGCTAGTCCGTTATCAACTT-GAAAAAGTGGCACCG AGTCGGTGCTTTTTTT) (SEQ ID NO: 3), and its reverse-complementary DNA on the other strand (5'>3', AAAAAAAGCACCGACTCGGTGC-CACTTTTTCAAGTTGATAACGGACTAGCCTTATTT-TAACTTGCTAT TTCTAGCTCTAAAAC) (SEQ ID NO: 4).

In some embodiments, a single-stranded DNA sequence encoding the gNA (e.g., gRNA) stem-loop sequence comprises the following DNA sequence: (5'>3', AAAAAAAGCACCGACTCGGTGC-CACTTTTTCAAGTTGATAACGGACTAGCCTTATTT-TAACTTGCTAT TTCTAGCTCTAAAAC) (SEQ ID NO: 4), wherein the single-stranded DNA serves as a transcription template.

In some embodiments, the gNA (e.g., gRNA) stem-loop sequence comprises the following RNA sequence: (5'>3', GUUUUAGAGCUAGAAAUAG-CAAGUUAAAAUAAGGCUAGUCCGUUAUCAAC-UUGAAAAAGUGGCA CCGAGUCGGUGC-UUUUUUU) (SEQ ID NO: 1).

In some embodiments, a double-stranded DNA sequence encoding the gNA (e.g., gRNA) stem-loop sequence comprises the following DNA sequence on one strand (5'>3', GTTTTAGAGCTATGCTGGAAACAGCATAGCAAGT-TAAAATAAGGCTAGTCCGTTATCAACTTGAAAA AGTGGCACCGAGTCGGTGCTTTTTTTC) (SEQ ID NO: 5), and its reverse-complementary DNA on the other strand (5'>3', GAAAAAAAGCACCGACTCGGTGC-CACTTTTTCAAGTTGATAACGGACTAGCCTTATTT-TAACTTGCT ATGCTGTTTCCAG-CATAGCTCTAAAAC) (SEQ ID NO: 6).

In some embodiments, a single-stranded DNA sequence encoding the gNA (e.g., gRNA) stem-loop sequence comprises the following DNA sequence: (5'>3', GAAAAAAAGCACCGACTCGGTGC-CACTTTTTCAAGTTGATAACGGACTAGCCTTATTT-TAACTTGCT ATGCTGTTTCCAG-CATAGCTCTAAAAC) (SEQ ID NO: 6), wherein the single-stranded DNA serves as a transcription template.

In some embodiments, the gNA (e.g., gRNA) stem-loop sequence comprises the following RNA sequence: (5'>3', GUUUUAGAGCUAUGCUGGAAACAGCAUAG-CAAGUUAAAAUAAGGCUAGUCCGUUAUCAAC-UUGA AAAAGUGGCACCGAGUCGGUGC-UUUUUUUC) (SEQ ID NO: 2).

In some embodiments, provided herein is a nucleic acid encoding for a gNA (e.g., gRNA) comprising a first segment comprising a regulatory region; a second segment encoding a targeting sequence; and a third segment comprising a nucleic acid encoding a nucleic acid-guided nuclease (e.g., CRISPR/Cas) system protein-binding sequence. In some embodiments, the third segment comprises a single transcribed component, which upon transcription yields a NA (e.g., RNA) stem-loop sequence. In some embodiments, the third segment comprising a single transcribed component that encodes for the gNA (e.g., gRNA) stem-loop sequence is double-stranded, comprises the following DNA sequence on one strand (5'>3', GTTTTAGAGCTAGAAATAG-CAAGTTAAAATAAGGCTAGTCCGTTATCAACTT-GAAAAAGTGGCACCG AGTCGGTGCTTTTTTT) (SEQ ID NO: 3), and its reverse-complementary DNA on the other strand (5'>3', AAAAAAAGCACCGACTCGGTGC-CACTTTTTCAAGTTGATAACGGACTAGCCTTATTT-TAACTTGCTAT TTCTAGCTCTAAAAC) (SEQ ID NO: 4). In some embodiments, the third segment comprising a single transcribed component that encodes for the gNA (e.g., gRNA) stem-loop sequence is single-stranded, and comprises the following DNA sequence: (5'>3', AAAAAAAGCACCGACTCGGTGC-CACTTTTTCAAGTTGATAACGGACTAGCCTTATTT-TAACTTGCTAT TTCTAGCTCTAAAAC) (SEQ ID NO: 4), wherein the single-stranded DNA serves as a transcription template. In some embodiments, upon transcription from the single transcribed component, the resulting gNA (e.g., gRNA) stem-loop sequence comprises the following RNA sequence: (5'>3', GUUUUAGAGCUAGAAAUAG-CAAGUUAAAAUAAGGCUAGUCCGUUAUCAAC-UUGAAAAAGUGGCA CCGAGUCGGUGC-UUUUUUU) (SEQ ID NO: 1). In some embodiments, the third segment comprising a single transcribed component that encodes for the gNA (e.g., gRNA) stem-loop sequence is double-stranded, comprises the following DNA sequence on one strand (5'>3', GTTTTAGAGCTATGCTGGAAACA-GCATAGCAAGTTAAAATAAGGCTAGTCCGTTAT-CAACTTGAAAA AGTGGCACCGAGTCGGT-GCTTTTTTTC) (SEQ ID NO: 5), and its reverse-complementary DNA on the other strand (5'>3', GAAAAAAAGCACCGACTCGGTGC-CACTTTTTCAAGTTGATAACGGACTAGCCTTATTT-TAACTTGCT ATGCTGTTTCCAG-CATAGCTCTAAAAC) (SEQ ID NO: 6). In some embodiments, the third segment comprising a single transcribed component that encodes for the gNA (e.g., gRNA) stem-loop sequence is single-stranded, and comprises the following DNA sequence: (5'>3', GAAAAAAAGCAC-CGACTCGGTGCCACTTTTTCAAGTTGATAACG-GACTAGCCTTATTTTAACTTGCT ATGCTGTTTCCAG-CATAGCTCTAAAAC) (SEQ ID NO: 6), wherein the single-stranded DNA serves as a transcription template. In some embodiments, upon transcription from the single transcribed component, the yielded gRNA stem-loop sequence comprises the following RNA sequence: (5'>3', GUUUUA-GAGCUAUGCUGGAAACAGCAUAG-CAAGUUAAAAUAAGGCUAGUCCGUUAUCAAC-UUGA AAAAGUGGCACCGAGUCGGUGCUUUUUUUC) (SEQ ID NO: 2). In some embodiments, the third segment comprises two sub-segments, which encode for a crRNA and a tracrRNA upon transcription. In some embodiment, the crRNA does not comprise the N20 plus the extra sequence which can hybridize with tracrRNA. In some embodiments, the crRNA comprises the extra sequence which can hybridize with tracrRNA. In some embodiments, the two sub-segments are independently transcribed. In some embodiments, the two sub-segments are transcribed as a single unit. In some embodiments, the DNA encoding the crRNA comprises $N_{target}$GTTTTAGAGCTATGCT-GTTTTG (SEQ ID NO: 7), where $N_{target}$ represents the targeting sequence. In some embodiments, the DNA encoding the tracrRNA comprises the sequence GGAACCAT-TCAAAACAGCATAGCAAGTTAAAATAAGGCTAGTC-CGTTATCAACTTGAAAAAGTGGC ACCGAGTCGGTGCTTTTTTT (SEQ ID NO: 8).

In some embodiments, provided herein is a nucleic acid encoding for a gNA (e.g., gRNA) comprising a first segment comprising a regulatory region; a second segment encoding a targeting sequence; and a third segment comprising a nucleic acid encoding a nucleic acid-guided nuclease (e.g., CRISPR/Cas) system protein-binding sequence. In some embodiments, the third segment comprises a DNA sequence, which upon transcription yields a gRNA stem-loop sequence capable of binding a nucleic acid-guided nuclease (e.g., CRISPR/Cas) system protein. In one embodiment, the DNA sequence can be double-stranded. In some embodiments, the third segment double stranded DNA comprises the following DNA sequence on one strand (5'>3', GTTTTAGAGCTA-GAAATAGCAAGTTAAAATAAGGCTAGTCCGTTAT-CAACTTGAAAAAGTGGCACCG AGTCGGT-GCTTTTTTT) (SEQ ID NO: 3), and its reverse-complementary DNA on the other strand (5'>3', AAAAAAAGCACCGACTCGGTGC-CACTTTTTCAAGTTGATAACGGACTAGCCTTATTT-TAACTTGCTAT TTCTAGCTCTAAAAC) (SEQ ID NO: 4). In some embodiments, the third segment double stranded DNA comprises the following DNA sequence on one strand (5'>3', GTTTTAGAGCTATGCTGGAAACAGCATAG-CAAGTTAAAATAAGGCTAGTCCGTTATCAACTT-GAAAA AGTGGCACCGAGTCGGTGCTTTTTTC) (SEQ ID NO: 5), and its reverse-complementary DNA on the other strand (5'>3', GAAAAAAAGCACCGACTCGGT-GCCACTTTTTCAAGTTGATAACGGACTAGCCTT-ATTTTAACTTGCT ATGCTGTTTCCAG-CATAGCTCTAAAAC) (SEQ ID NO: 6). In one embodiment, the DNA sequence can be single-stranded. In some embodiments, the third segment single stranded DNA comprises the following DNA sequence (5'>3', AAAAAAAGCACCGACTCGGTGC-CACTTTTTCAAGTTGATAACGGACTAGCCTTATTT-TAACTTGCTAT TTCTAGCTCTAAAAC) (SEQ ID NO: 4), wherein the single-stranded DNA serves as a transcription template. In some embodiments, the third segment single stranded DNA comprises the following DNA sequence (5'>3', GAAAAAAAGCACCGACTCGGTGC-CACTTTTTCAAGTTGATAACGGACTAGCCTTATTT-TAACTTGCT ATGCTGTTTCCAG-CATAGCTCTAAAAC) (SEQ ID NO: 6), wherein the single-stranded DNA serves as a transcription template. In some embodiments, the third segment comprises a DNA sequence which, upon transcription, yields a first RNA sequence that is capable of forming a hybrid with a second RNA sequence, and which hybrid is capable of CRISPR/Cas system protein binding. In some embodiments, the third segment is double-stranded DNA comprising the DNA sequence on one strand: (5'>3', GTTTTAGAGCTATGCT-GTTTTG) (SEQ ID NO: 9) and its reverse complementary DNA sequence on the other strand: (5'>3', CAAAACAG-CATAGCTCTAAAAC) (SEQ ID NO: 10). In some embodiments, the third segment is single-stranded DNA comprising the DNA sequence of (5'>3', CAAAACAG-CATAGCTCTAAAAC) (SEQ ID NO: 10). In some embodiments, the second segment and the third segment together encode for a crRNA sequence. In some embodiments, the second RNA sequence that is capable of forming a hybrid with the first RNA sequence encoded by the third segment of the nucleic acid encoding a gRNA is a tracrRNA. In some embodiments, the tracrRNA comprises the sequence (5'>3', GGAACCAUUCAAAACAGCAUAG-CAAGUUAAAAUAAGGCUAGUCCGUUAUCAAC-UUGAAAAAGUG GCACCGAGUCGGUGC-UUUUUUU) (SEQ ID NO: 11). In some embodiments, the tracrRNA is encoded by a double-stranded DNA comprising sequence of (5'>3', GGAACCATTCAAAACAGCATAG-CAAGTTAAAATAAGGCTAGTCCGTTATCAACTT-GAAAAGTGGC ACCGAGTCGGTGCTTTTTTT) (SEQ ID NO: 8), and optionally fused with a regulatory sequence at its 5' end. In some embodiments, the regulatory sequence can be bound by a transcription factor. In some embodiments, the regulatory sequence is a promoter. In some embodiments, the regulatory sequence is a T7 promoter, comprising the sequence of (5'>3', GCCTC-GAGCTAATACGACTCACTATAGAG) (SEQ ID NO: 12).

In some embodiments, provided herein is a nucleic acid encoding for a gNA comprising a first segment comprising a regulatory region; a second segment encoding a targeting sequence; and a third segment comprising a nucleic acid encoding a nucleic acid-guided nuclease (e.g., CRISPR/Cas) system protein-binding sequence. In some embodiments, the third segment encodes for a RNA sequence that, upon post-transcriptional cleavage, yields a first RNA segment and a second RNA segment. In some embodiments, the first RNA segment comprises a crRNA and the second RNA segment comprises a tracrRNA, which can form a hybrid and together, provide for nucleic acid-guided nuclease (e.g., CRISPR/Cas) system protein binding. In some embodiments, the third segment further comprises a spacer in between the transcriptional unit for the first RNA segment and the second RNA segment, which spacer comprises an enzyme cleavage site.

In some embodiments, provided herein is a gNA (e.g., gRNA) comprising a first NA segment comprising a targeting sequence and a second NA segment comprising a nucleic acid-guided nuclease (e.g., CRISPR/Cas) system protein-binding sequence. In some embodiments, the size of the first segment is greater than 30 bp. In some embodiments, the second segment comprises a single segment, which comprises the gRNA stem-loop sequence. In some embodiments, the gRNA stem-loop sequence comprises the following RNA sequence: (5'>3', GUUUUAGAGCUAGAAAUAG-CAAGUUAAAAUAAGGCUAGUCCGUUAUCAAC-UUGAAAAAGUGGCA CCGAGUCGGUGC-UUUUUUU) (SEQ ID NO: 1). In some embodiments, the gRNA stem-loop sequence comprises the following RNA sequence: (5'>3', GUUUUAGAGCUAUGCUGGAAACA-GCAUAGCAAGUUAAAAUAAGGCUAGUCCGUUAU-CAACUUGA AAAAGUGGCACCGAGUCGGUGC-UUUUUUUC) (SEQ ID NO: 2). In some embodiments, the second segment comprises two sub-segments: a first RNA sub-segment (crRNA) that forms a hybrid with a second RNA sub-segment (tracrRNA), which together act to direct nucleic acid-guided nuclease (e.g., CRISPR/Cas) system protein binding. In some embodiments, the sequence of the second sub-segment comprises GUUUUAGAGC-UAUGCUGUUUUG. In some embodiments, the first RNA segment and the second RNA segment together forms a crRNA sequence. In some embodiments, the other RNA that will form a hybrid with the second RNA segment is a tracrRNA. In some embodiments the tracrRNA comprises the sequence of 5'>3', GGAACCAUUCAAAACAG-CAUAGCAAGUUAAAAUAAGGCUAGUCCGUUAU-CAACUUGAAAAAGUG GCACCGAGUCGGUGC-UUUUUUU (SEQ ID NO: 11).

CRISPR/Cas System Nucleic Acid-Guided Nucleases

In some embodiments, CRISPR/Cas system proteins are used in the embodiments provided herein. In some embodiments, CRISPR/Cas system proteins include proteins from CRISPR Type I systems, CRISPR Type II systems, and CRISPR Type III systems.

In some embodiments, CRISPR/Cas system proteins can be from any bacterial or archaeal species.

In some embodiments, the CRISPR/Cas system protein is isolated, recombinantly produced, or synthetic.

In some embodiments, the CRISPR/Cas system proteins are from, or are derived from CRISPR/Cas system proteins from *Streptococcus pyogenes, Staphylococcus aureus, Neisseria meningitidis, Streptococcus thermophiles, Treponema* denticola, *Francisella tularensis, Pasteurella multocida, Campylobacter jejuni, Campylobacter lari, Mycoplasma gallisepticum, Nitratifractor salsuginis, Parvibaculum lavamentivorans, Roseburia intestinalis, Neisseria cinerea, Gluconacetobacter diazotrophicus, Azospirillum, Sphaerochaeta globus, Flavobacterium columnare, Fluviicola taffensis, Bacteroides coprophilus, Mycoplasma mobile, Lactobacillus farciminis, Streptococcus pasteurianus, Lactobacillus johnsonii, Staphylococcus pseudintermedius, Filifactor alocis, Legionella pneumophila, Suterella wadsworthensis*, or *Corynebacter diphtheria.*

In some embodiments, examples of CRISPR/Cas system proteins can be naturally occurring or engineered versions.

In some embodiments, naturally occurring CRISPR/Cas system proteins can belong to CAS Class I Type I, III, or IV, or CAS Class II Type II or V, and can include Cas9, Cas3, Cas8a-c, Cas10, Cse1, Csy1, Csn2, Cas4, Csm2, Cmr5, Csf1, C2c2, and Cpf1.

In an exemplary embodiment, the CRISPR/Cas system protein comprises Cas9.

A "CRISPR/Cas system protein-gNA complex" refers to a complex comprising a CRISPR/Cas system protein and a guide NA (e.g. a gRNA or a gDNA). Where the gNA is a gRNA, the gRNA may be composed of two molecules, i.e., one RNA ("crRNA") which hybridizes to a target and provides sequence specificity, and one RNA, the "tracrRNA", which is capable of hybridizing to the crRNA. Alternatively, the guide RNA may be a single molecule (i.e., a gRNA) that contains crRNA and tracrRNA sequences.

A CRISPR/Cas system protein may be at least 60% identical (e.g., at least 70%, at least 80%, or 90% identical, at least 95% identical or at least 98% identical or at least 99% identical) to a wild type CRISPR/Cas system protein. The CRISPR/Cas system protein may have all the functions of a wild type CRISPR/Cas system protein, or only one or some of the functions, including binding activity, nuclease activity, and nuclease activity.

The term "CRISPR/Cas system protein-associated guide NA" refers to a guide NA. The CRISPR/Cas system protein-associated guide NA may exist as isolated NA, or as part of a CRISPR/Cas system protein-gNA complex.

Cas9

In some embodiments, the CRISPR/Cas System protein nucleic acid-guided nuclease is or comprises Cas9. The Cas9 of the present invention can be isolated, recombinantly produced, or synthetic.

Examples of Cas9 proteins that can be used in the embodiments herein can be found in F. A. Ran, L. Cong, W. X. Yan, D. A. Scott, J. S. Gootenberg, A. J. Kriz, B. Zetsche, O. Shalem, X. Wu, K S. Makarova, E. V. Koonin, P. A. Sharp, and F. Zhang; "In vivo genome editing using *Staphylococcus aureus* Cas9," Nature 520, 186-191 (9 Apr. 2015) doi:10.1038/nature14299, which is incorporated herein by reference.

In some embodiments, the Cas9 is a Type II CRISPR system derived from *Streptococcus pyogenes, Staphylococcus aureus, Neisseria meningitidis, Streptococcus thermophiles, Treponema denticola, Francisella tularensis, Pasteurella multocida, Campylobacter jejuni, Campylobacter lari, Mycoplasma gallisepticum, Nitratifractor salsuginis, Parvibaculum lavamentivorans, Roseburia intestinalis, Neisseria cinerea, Gluconacetobacter diazotrophicus, Azospirillum, Sphaerochaeta globus, Flavobacterium columnare, Fluviicola taffensis, Bacteroides coprophilus, Mycoplasma mobile, Lactobacillus farciminis, Streptococcus pasteurianus, Lactobacillus johnsonii, Staphylococcus pseudintermedius, Filifactor alocis, Legionella pneumophila, Suterella wadsworthensis*, or *Corynebacter diphtheria.*

In some embodiments, the Cas9 is a Type II CRISPR system derived from *S. pyogenes* and the PAM sequence is NGG located on the immediate 3' end of the target specific guide sequence. The PAM sequences of Type II CRISPR systems from exemplary bacterial species can also include: *Streptococcus pyogenes* (NGG), *Staph aureus* (NNGRRT), *Neisseria meningitidis* (NNNNGA TT), *Streptococcus thermophilus* (NNAGAA) and *Treponema denticola* (NAAAAC) which are all usable without deviating from the present invention.

In one exemplary embodiment, Cas9 sequence can be obtained, for example, from the pX330 plasmid (available from Addgene), re-amplified by PCR then cloned into pET30 (from EMD biosciences) to express in bacteria and purify the recombinant 6His tagged protein.

A "Cas9-gNA complex" refers to a complex comprising a Cas9 protein and a guide NA. A Cas9 protein may be at least 60% identical (e.g., at least 70%, at least 80%, or 90% identical, at least 95% identical or at least 98% identical or at least 99% identical) to a wild type Cas9 protein, e.g., to the *Streptococcus pyogenes* Cas9 protein. The Cas9 protein may have all the functions of a wild type Cas9 protein, or only one or some of the functions, including binding activity, nuclease activity, and nuclease activity.

The term "Cas9-associated guide NA" refers to a guide NA as described above. The Cas9-associated guide NA may exist isolated, or as part of a Cas9-gNA complex.

Non-CRISPR/Cas System Nucleic Acid-Guided Nucleases

In some embodiments, non-CRISPR/Cas system proteins are used in the embodiments provided herein.

In some embodiments, the non-CRISPR/Cas system proteins can be from any bacterial or archaeal species.

In some embodiments, the non-CRISPR/Cas system protein is isolated, recombinantly produced, or synthetic.

In some embodiments, the non-CRISPR/Cas system proteins are from, or are derived from *Aquifex aeolicus, Thermus thermophilus, Streptococcus pyogenes, Staphylococcus aureus, Neisseria meningitidis, Streptococcus thermophiles, Treponema denticola, Francisella tularensis, Pasteurella multocida, Campylobacter jejuni, Campylobacter lari, Mycoplasma gallisepticum, Nitratifractor salsuginis, Parvibaculum lavamentivorans, Roseburia intestinalis, Neisseria cinerea, Gluconacetobacter diazotrophicus, Azospirillum, Sphaerochaeta globus, Flavobacterium columnare, Fluviicola taffensis, Bacteroides coprophilus, Mycoplasma mobile, Lactobacillus farciminis, Streptococcus pasteurianus, Lactobacillus johnsonii, Staphylococcus pseudintermedius, Filifactor alocis, Legionella pneumophila, Suterella wadsworthensis, Natronobacterium gregoryi*, or *Corynebacter diphtheria.*

In some embodiments, the non-CRISPR/Cas system proteins can be naturally occurring or engineered versions.

In some embodiments, a naturally occurring non-CRISPR/Cas system protein is NgAgo (Argonaute from *Natronobacterium gregoryi*).

A "non-CRISPR/Cas system protein-gNA complex" refers to a complex comprising a non-CRISPR/Cas system protein and a guide NA (e.g. a gRNA or a gDNA). Where the gNA is a gRNA, the gRNA may be composed of two molecules, i.e., one RNA ("crRNA") which hybridizes to a target and provides sequence specificity, and one RNA, the "tracrRNA", which is capable of hybridizing to the crRNA. Alternatively, the guide RNA may be a single molecule (i.e., a gRNA) that contains crRNA and tracrRNA sequences.

A non-CRISPR/Cas system protein may be at least 60% identical (e.g., at least 70%, at least 80%, or 90% identical, at least 95% identical or at least 98% identical or at least 99% identical) to a wild type non-CRISPR/Cas system protein. The non-CRISPR/Cas system protein may have all the functions of a wild type non-CRISPR/Cas system protein, or only one or some of the functions, including binding activity, nuclease activity, and nuclease activity.

The term "non-CRISPR/Cas system protein-associated guide NA" refers to a guide NA. The non-CRISPR/Cas system protein-associated guide NA may exist as isolated NA, or as part of a non-CRISPR/Cas system protein-gNA complex.

Catalytically Dead Nucleic Acid-Guided Nucleases

In some embodiments, engineered examples of nucleic acid-guided nucleases include catalytically dead nucleic acid-guided nucleases (CRISPR/Cas system nucleic acid-guided nucleases or non-CRISPR/Cas system nucleic acid-guided nucleases). The term "catalytically dead" generally refers to a nucleic acid-guided nuclease that has inactivated nucleases, for example inactivated HNH and RuvC nucleases. Such a protein can bind to a target site in any nucleic acid (where the target site is determined by the guide NA), but the protein is unable to cleave or nick the nucleic acid.

Accordingly, the catalytically dead nucleic acid-guided nuclease allows separation of the mixture into unbound nucleic acids and catalytically dead nucleic acid-guided nuclease-bound fragments. In one exemplary embodiment, a dCas9/gRNA complex binds to the targets determined by the gRNA sequence. The dCas9 bound can prevent cutting by Cas9 while other manipulations proceed.

In another embodiment, the catalytically dead nucleic acid-guided nuclease can be fused to another enzyme, such as a transposase, to target that enzyme's activity to a specific site.

In some embodiments, the catalytically dead nucleic acid-guided nuclease is dCas9, dCpf1, dCas3, dCas8a-c, dCas10, dCse1, dCsy1, dCsn2, dCas4, dCsm2, dCm5, dCsf1, dC2C2, or dNgAgo.

In one exemplary embodiment the catalytically dead nucleic acid-guided nuclease protein is a dCas9.

Nucleic Acid-Guided Nuclease Nickases

In some embodiments, engineered examples of nucleic acid-guided nucleases include nucleic acid-guided nuclease nickases (referred to interchangeably as nickase nucleic acid-guided nucleases).

In some embodiments, engineered examples of nucleic acid-guided nucleases include CRISPR/Cas system nickases or non-CRISPR/Cas system nickases, containing a single inactive catalytic domain.

In some embodiments, the nucleic acid-guided nuclease nickase is a Cas9 nickase, Cpf1 nickase, Cas3 nickase, Cas8a-c nickase, Cas10 nickase, Cse1 nickase, Csy1 nickase, Csn2 nickase, Cas4 nickase, Csm2 nickase, Cm5 nickase, Csf1 nickase, C2C2 nickase, or a NgAgo nickase.

In one embodiment, the nucleic acid-guided nuclease nickase is a Cas9 nickase.

In some embodiments, a nucleic acid-guided nuclease nickase can be used to bind to target sequence. With only one active nuclease domain, the nucleic acid-guided nuclease nickase cuts only one strand of a target DNA, creating a single-strand break or "nick". Depending on which mutant is used, the guide NA-hybridized strand or the non-hybridized strand may be cleaved. nucleic acid-guided nuclease nickases bound to 2 gNAs that target opposite strands can create a double-strand break in the nucleic acid. This "dual nickase" strategy increases the specificity of cutting because it requires that both nucleic acid-guided nuclease/gNA complexes be specifically bound at a site before a double-strand break is formed.

In exemplary embodiments, a Cas9 nickase can be used to bind to target sequence. The term "Cas9 nickase" refers to a modified version of the Cas9 protein, containing a single inactive catalytic domain, i.e., either the RuvC- or the HNH-domain. With only one active nuclease domain, the Cas9 nickase cuts only one strand of the target DNA, creating a single-strand break or "nick". Depending on which mutant is used, the guide RNA-hybridized strand or the non-hybridized strand may be cleaved. Cas9 nickases bound to 2 gRNAs that target opposite strands will create a double-strand break in the DNA. This "dual nickase" strategy can increase the specificity of cutting because it requires that both Cas9/gRNA complexes be specifically bound at a site before a double-strand break is formed.

Capture of DNA can be carried out using a nucleic acid-guided nuclease nickase. In one exemplary embodiment, a nucleic acid-guided nuclease nickase cuts a single strand of double stranded nucleic acid, wherein the double stranded region comprises methylated nucleotides.

Dissociable and Thermostable Nucleic Acid-Guided Nucleases

In some embodiments, thermostable nucleic acid-guided nucleases are used in the methods provided herein (thermostable CRISPR/Cas system nucleic acid-guided nucleases or thermostable non-CRISPR/Cas system nucleic acid-guided nucleases). In such embodiments, the reaction temperature is elevated, inducing dissociation of the protein; the reaction temperature is lowered, allowing for the generation of additional cleaved target sequences. In some embodiments, thermostable nucleic acid-guided nucleases maintain at least 50% activity, at least 55% activity, at least 60% activity, at least 65% activity, at least 70% activity, at least 75% activity, at least 80% activity, at least 85% activity, at least 90% activity, at least 95% activity, at least 96% activity, at least 97% activity, at least 98% activity, at least 99% activity, or 100% activity, when maintained for at least 75° C. for at least 1 minute. In some embodiments, thermostable nucleic acid-guided nucleases maintain at least 50% activity, when maintained for at least 1 minute at least at 75° C., at least at 80° C., at least at 85° C., at least at 90° C., at least at 91° C., at least at 92° C., at least at 93° C., at least at 94° C., at least at 95° C., 96° C., at least at 97° C., at least at 98° C., at least at 99° C., or at least at 100° C. In some embodiments, thermostable nucleic acid-guided nucleases maintain at least 50% activity, when maintained at least at 75° C. for at least 1 minute, 2 minutes, 3 minutes, 4 minutes, or 5 minutes. In some embodiments, a thermostable nucleic acid-guided nuclease maintains at least 50% activity when the temperature is elevated, lowered to 25° C.–50° C. In some embodiments, the temperature is lowered to 25° C., to 30° C., to 35° C., to 40° C., to 45° C., or to 50° C. In one exemplary embodiment, a thermostable enzyme retains at least 90% activity after 1 min at 95° C.

In some embodiments, the thermostable nucleic acid-guided nuclease is thermostable Cas9, thermostable Cpf1, thermostable Cas3, thermostable Cas8a-c, thermostable Cas10, thermostable Cse1, thermostable Csy1, thermostable Csn2, thermostable Cas4, thermostable Csm2, thermostable Cm5, thermostable Csf1, thermostable C2C2, or thermostable NgAgo.

In some embodiments, the thermostable CRISPR/Cas system protein is thermostable Cas9.

Thermostable nucleic acid-guided nucleases can be isolated, for example, identified by sequence homology in the genome of thermophilic bacteria *Streptococcus thermophilus* and *Pyrococcus furiosus*. Nucleic acid-guided nuclease genes can then be cloned into an expression vector. In one exemplary embodiment, a thermostable Cas9 protein is isolated.

In another embodiment, a thermostable nucleic acid-guided nuclease can be obtained by in vitro evolution of a non-thermostable nucleic acid-guided nuclease. The sequence of a nucleic acid-guided nuclease can be mutagenized to improve its thermostability.

Methods of Making Collections of gNAs

Provided herein are methods that enable the generation of a large number of diverse gRNAs, collections of gNAs, from any source nucleic acid (e.g., DNA). Methods provided herein can employ enzymatic methods including but not limited to digestion, ligation, extension, overhang filling, transcription, reverse transcription, amplification.

Generally, the method can comprise providing a nucleic acid (e.g., DNA); employing a first enzyme (or combinations of first enzymes) that cuts at a part of the PAM sequence in the nucleic acid, in a way that a residual nucleotide sequence from the PAM sequence is left; ligating an adapter that positions a restriction enzyme typeIIS site (an enzyme that cuts outside yet near its recognition motif) at a distance to eliminate the PAM sequence; employing a second typeIIS enzyme (or combination of second enzymes) to eliminate the PAM sequence together with the adapter; and fusing a sequence that can be recognized by protein members of the nucleic acid-guided nuclease (e.g., CRISPR/Cas) system, for example, a gRNA stem-loop sequence. In some embodiments, the first enzymatic reactions cuts part of the PAM sequence in a way that residual nucleotide sequence from the PAM sequence is left, and that the nucleotide sequence immediately 5' to the PAM sequence can be any purine or pyrimidine, not just those with a cytosine 5' to the PAM sequence, for example, not just those that are C/NGG or C/TAG, etc.

Table 1 shows exemplary strategies/protocols to convert any source nucleic acid (e.g., DNA) into a collection of gNAs (e.g., gRNAs) using different restriction enzymes.

TABLE 1

Exemplary strategies for preparing a collection of guide nucleic acids.

| CRISPR/Cas System Species | PAM Sequence | First Enzyme/ Components | Strategy | 3' Adapter sequence with typeIIS enzyme site (provided with only one strand sequence 5' > 3') |
|---|---|---|---|---|
| *Streptococcus pyogenes* (SP); SpCas9 | NGG | CviPII | Nicks immediately 5' of CCD sequence, nicks the other strand with T7 endonuclease I, blunt with T4 DNA polymerase; ligate to adapter; cut with MlyI to remove PAM and adapter; ligate gRNA stem-loop sequence at 3' end | ggGACTCggatccctatagtc (SEQ ID NO: 4421) |
| *Staphylococcus aureus* (SA); SaCas9 | NNGRRT or NNGRR (N) | AlwI | Cut, blunt with T4 DNA polymerase; ligate to adapter SA; cut with EcoP15I to remove PAM and adapter; blunt end; ligate gRNA stem-loop sequence at 3' end | ttttagcggccgcctgctgCTCtacaa agacgatgacgacaagcgt (SEQ ID NO: 4422) |
| *Neisseria meningitidis* (NM) | NNNNGA TT | TfiI | Cut, blunt with T4 DNA polymerase; ligate to adapter NM; cut with EcoRI to eliminate un-wanted DNA and EcoP15I to remove PAM and adapter; blunt end; ligate gRNA stem-loop sequence at 3' end | TCgcggccgcttttattctgctgCTCt acaaagacgatgacgacaagcgt (SEQ ID NO: 4428) |
| *Streptococcus thermophilus* (ST) | NNAGAA W | BsmI | Cut, blunt with T4 DNA polymerase; ligate to adapter ST; cut with EcoP15I to remove PAM and adapter; blunt end; ligate gRNA stem-loop sequence at 3' end | ttgcggccgcttttattctgctgCTCt acaaagacgatgacgacaagcgt (SEQ ID NO: 4429) |
| *Treponema denticola* (TD) | NAAAAC | Cly7489I | Cut, blunt with T4 DNA polymerase; ligate to adapter TD; cut with EcoP15I to remove PAM and adapter | tttagcggccgcctgctgCTCtacaaa gacgatgacgacaagcgt (SEQ ID NO: 4430) |

Table 2 shows additional exemplary strategies/protocols to convert any source nucleic acid (e.g., DNA) into a collection of gNAs (e.g., gRNAs) using different restriction enzymes.

TABLE 2

Additional exemplary strategies for preparing a collection of guide nucleic acids.

| CRISPR/ Cas System Species | PAM Sequence | First Enzyme/ Component | Exemplary Strategy | Adapter oligo sequence (with Inosine overhangs, all in 5' > 3' direction) |
|---|---|---|---|---|
| Streptococcus pyogenes (SP); SpCas9 | NGG | CviPII | Nicks immediately 5' of CCD sequence, nicks the other strand with T7 endonuclease I; ligate to adapter; cut with MlyI to remove PAM and 3' adapter; ligate gRNA stem-loop sequence at 3' end | Adapter oligo 1: ggggGACTCggatccctatagtgatac aaagacgatgacgacaagcg (SEQ ID NO: 4404) Adapter oligo 2: gcctcgagc*t*a*atacgactcactatag ggatccaagtccc (* denotes a phosphorothioate backbone linkage) (SEQ ID NO: 4405) |
| Staphylococcus aureus (SA); SaCas9 | NNGRRT or NNGRR (N) | AlwI | Cut; ligate to adapter SA; cut with EcoP15I to remove PAM and 3' adapter; blunt end; ligate gRNA stem-loop sequence at 3' end | Adapter oligo 1: IttttagcggccgcctgctgCTCtacaaa gacgatgacgacaagcgt (SEQ ID NO: 4422) Adapter oligo 2: gagatcagcttctgcattgatgcGAGcag caggcggccgctaaaa (SEQ ID NO: 4423) |
| Neisseria meningitidis (NM) | NNNNGATT | TfiI | Cut; ligate to adapter NM; cut with EcoP15I to remove PAM and 3' adapter; blunt end; ligate gRNA stem-loop sequence at 3' end | Adapter oligo 1: attTCgcggccgcttttattctgctgCTCt acaaagacgatgacgacaagcgt (SEQ ID NO: 4424) Adapter oligo 2: gagatcagcttctgcattgatgcGAGcag cagaataaaagcggccgcGA (SEQ ID NO: 4425) |
| Streptococcus thermophilus (ST) | NNAGAAW | BsmI | Cut; ligate to adapter ST; cut with EcoP15I to remove PAM and 3' adapter; blunt end; ligate gRNA stem-loop sequence at 3' end | Adapter oligo 1: gcggccgcttttattctgctgCTCtacaaa gacgatgacgacaagcgt (SEQ ID NO: 4426) Adapter oligo 2: gagatcagcttctgcattgatgcGAGcag cagaataaaagcggccgcIG (SEQ ID NO: 4427) |

Exemplary applications of the compositions and methods described herein are provided in FIG. 1, FIG. 2, FIG. 3, FIG. 4, FIG. 5, FIG. 6, and FIG. 7. The figures depict non-limiting exemplary embodiments of the present invention that includes a method of constructing a gNA library (e.g., gRNA library) from input nucleic acids (e.g., DNA), such as genomic DNA (e.g., human genomic DNA).

In FIG. 1, the starting material can be fragmented genomic DNA (e.g., human) or other source DNA. These fragments are blunt-ended before constructing the library 101. T7 promoter adapters are ligated to the blunt-ended DNA fragments 102, which is then PCR amplified. Nt.CviPII is then used to generate a nick on one strand of the PCR product immediately 5' to the CCD sequence 103. T7 Endonuclease I cleaves on the opposite strand 1, 2, or 3 bp 5' of the nick 104. The resulting DNA fragments are blunt-ended with T4 DNA Polymerase, leaving HGG sequence at the end of the DNA fragment 105. The resulting DNA is cleaned and recovered on beads. An adapter carrying MlyI recognition site is ligated to the blunt-ended DNA fragment immediately 3' of HGG sequence 106. MlyI generates a blunt-end cleavage immediately 5' to the HGG sequence, removing HGG together with the adapter sequence 107. The resulting DNA fragments are cleaned and recovered again on beads. A gRNA stem-loop sequence is then ligated to the blunt-end cleaved by MlyI, forming a gRNA library covering the human genome 108. This library of DNA is then PCR amplified and cleaned on beads, ready for in vitro transcription.

Figure 2:
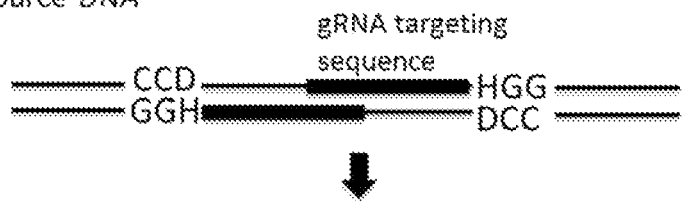
FIG. 2 illustrates another exemplary scheme for producing a collection of gRNAs (a gRNA library) from genomic DNA.
Figure 2:
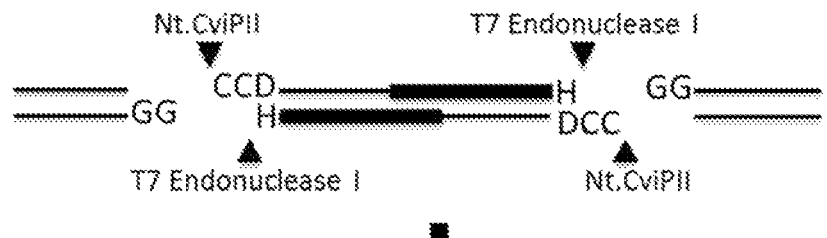
Figure 2:
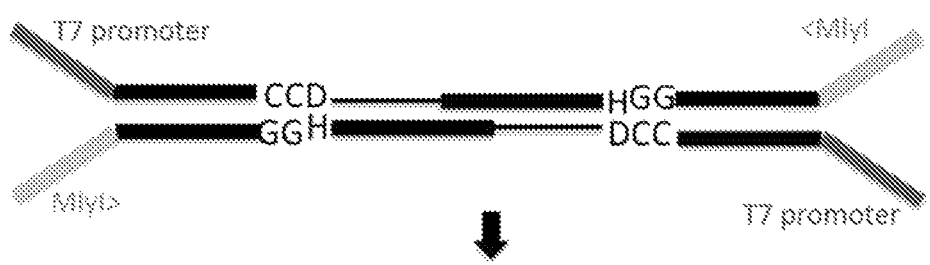
Figure 2:
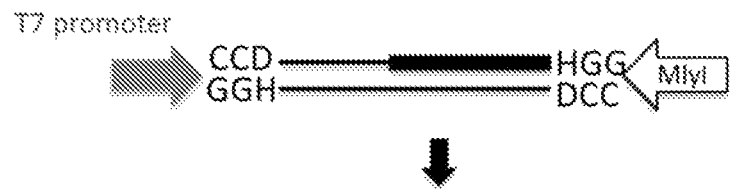
Figure 2:
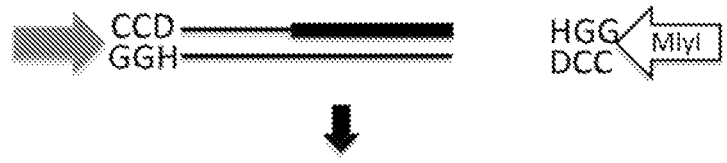
Figure 2:

In FIG. 2, the starting material can intact genomic DNA (e.g., human) or other source DNA 201. Nt.CviPII and T7 Endonuclease I are used to generate nicks on each strand of the human genomic DNA, resulting in smaller DNA fragments 202. DNA fragments of 200-600 bp are size selected on beads, then ligated with Y-shaped adapters carrying a GG overhang on the 5'. One strand of the Y-shaped adapter contains a MlyI recognition site, wherein the other strand contains a mutated MlyI site and a T7 promoter sequence 203. Because of these features, after PCR amplification, the T7 promoter sequence is at the distal end of the HGG sequence, and the MlyI sequence is at the rear end of HGG 204. Digestion with MlyI generates a cleavage immediately 5' of HGG sequence 205. MlyI generates a blunt-end cleavage immediately 5' to the HGG sequence, removing HGG together with the adapter sequence 206. A gRNA stem-loop sequence is then ligated to the blunt-end cleaved by MlyI, forming a gRNA library covering the human genome. This library of DNA is then PCR amplified and cleaned on beads, ready for in vitro transcription.

Figure 3:
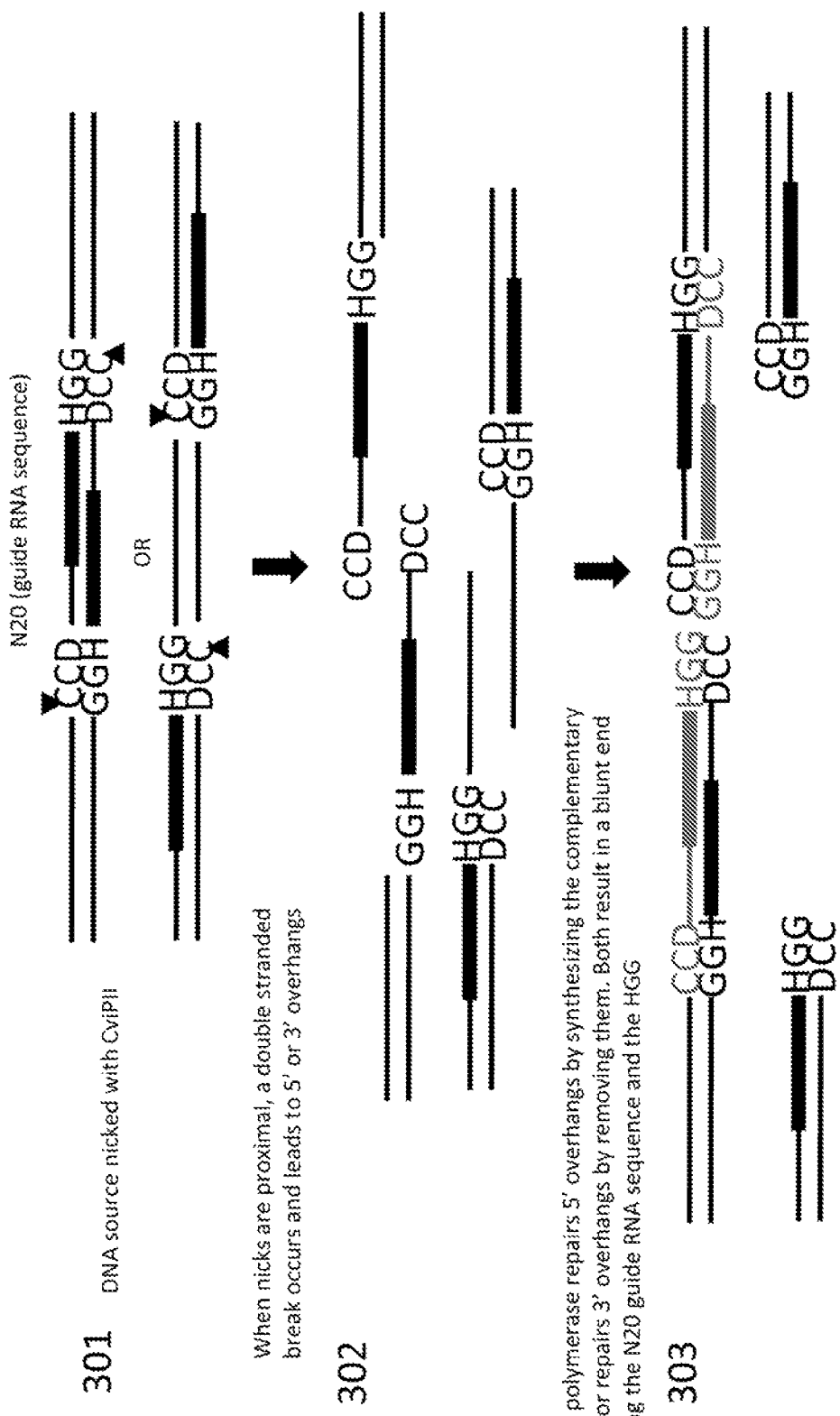
FIG. 3 illustrates an exemplary scheme for nicking of DNA and subsequent treatment with polymerase to generate blunt ends.

In FIG. 3, the source DNA (e.g., genomic DNA) can be nicked 301, for example with a nicking enzyme. In some cases, the nicking enzyme can have a recognition site that is three or fewer bases in length. In some cases, CviPII is used, which can recognize and nick at a sequence of CCD (where D represents a base other than C). Nicks can be proximal, surrounding a region containing the sequence (represented by the thicker line) which will be used to yield the guide RNA N20 sequence. When nicks are proximal, a double stranded break can occur and lead to 5' or 3' overhangs 302. These overhangs can be repaired, for example with a polymerase (e.g., T4 polymerase). In some cases, such as with 5' strands, repair can comprise synthesizing a complementary strand. In some case, such as with 3' strands, repair can comprise removing overhangs. Repair can result in a blunt end including the N20 guide sequence and a sequence complementary to the nick recognition sequence (e.g., HGG, where H represents a base other than G).

Figure 4:
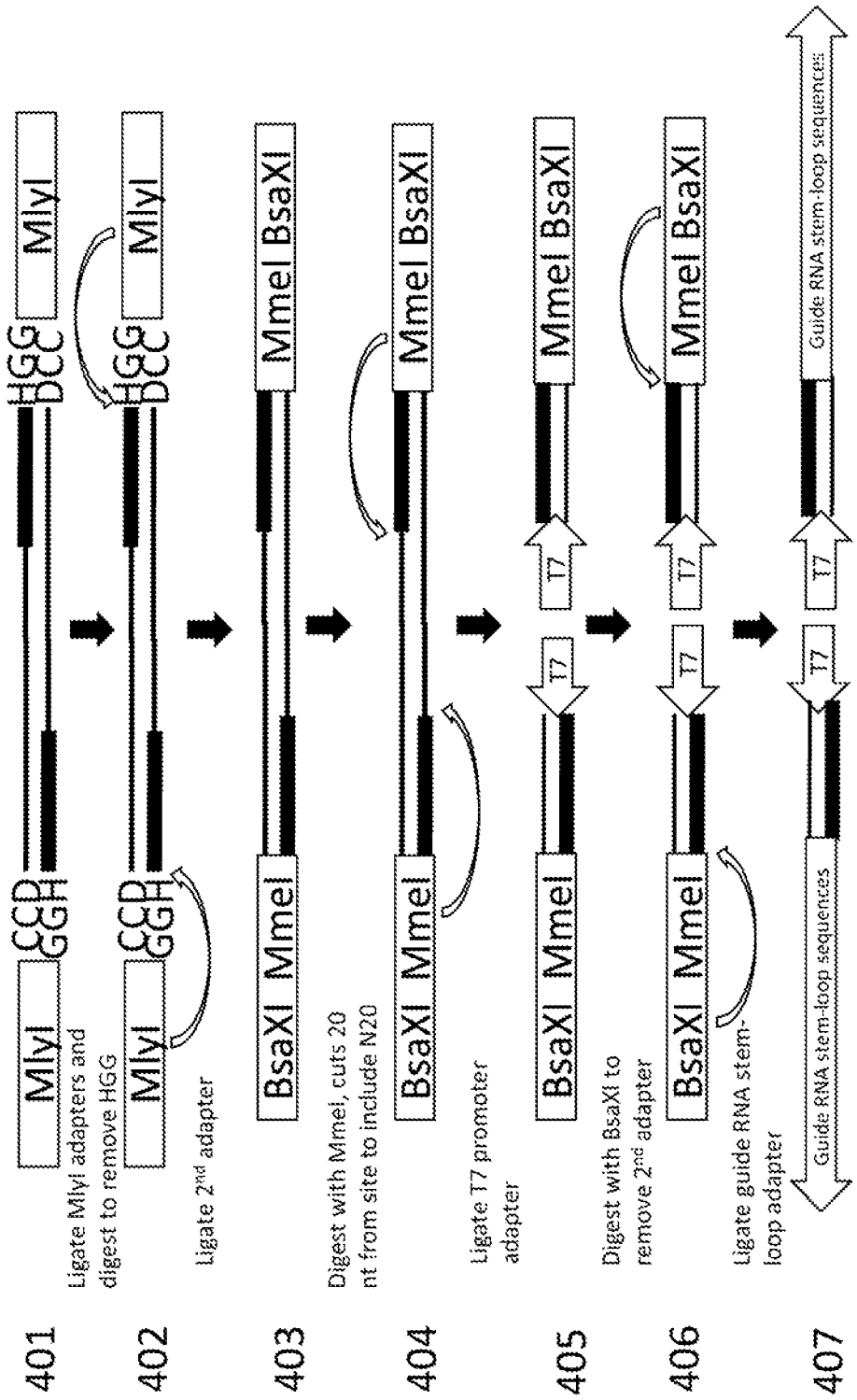
FIG. 4 illustrates an exemplary scheme for sequential production of a library of gNAs using three adapters.

In FIG. 4, continuing for example from the end of FIG. 3, different combinations of adapters can be ligated to the DNA to allow for the desired cleaving. Adapters with a recognition site for a nuclease enzyme that cuts 3 base pairs from the site (e.g., MlyI) can be ligated 401, and digestion at that site can be used to remove a left over sequence, such as an HGG sequence 402. Adapters with a recognition site for a nuclease that cuts 20 base pairs from the site (e.g., MmeI) 403. These adapters can also include a second recognition site for a nuclease that cuts the proper number of nucleotides from the site to later remove the first recognition site (e.g., BsaXI). The first enzyme can be used to cut 20 nucleotides down, thereby keeping the N20 sequence 404. Then, a promoter adapter (e.g., T7) can be ligated next to the N20 sequence 405. Then, the nuclease corresponding to the second recognition site (e.g., BsaXI) can be used to remove the adapter for the site that cuts 20 nucleotides away (e.g., MmeI) 406. Finally, the guide RNA stem-loop sequence adapter can be ligated to the N20 sequence 407 to prepare for guide RNA production.

Figure 5:
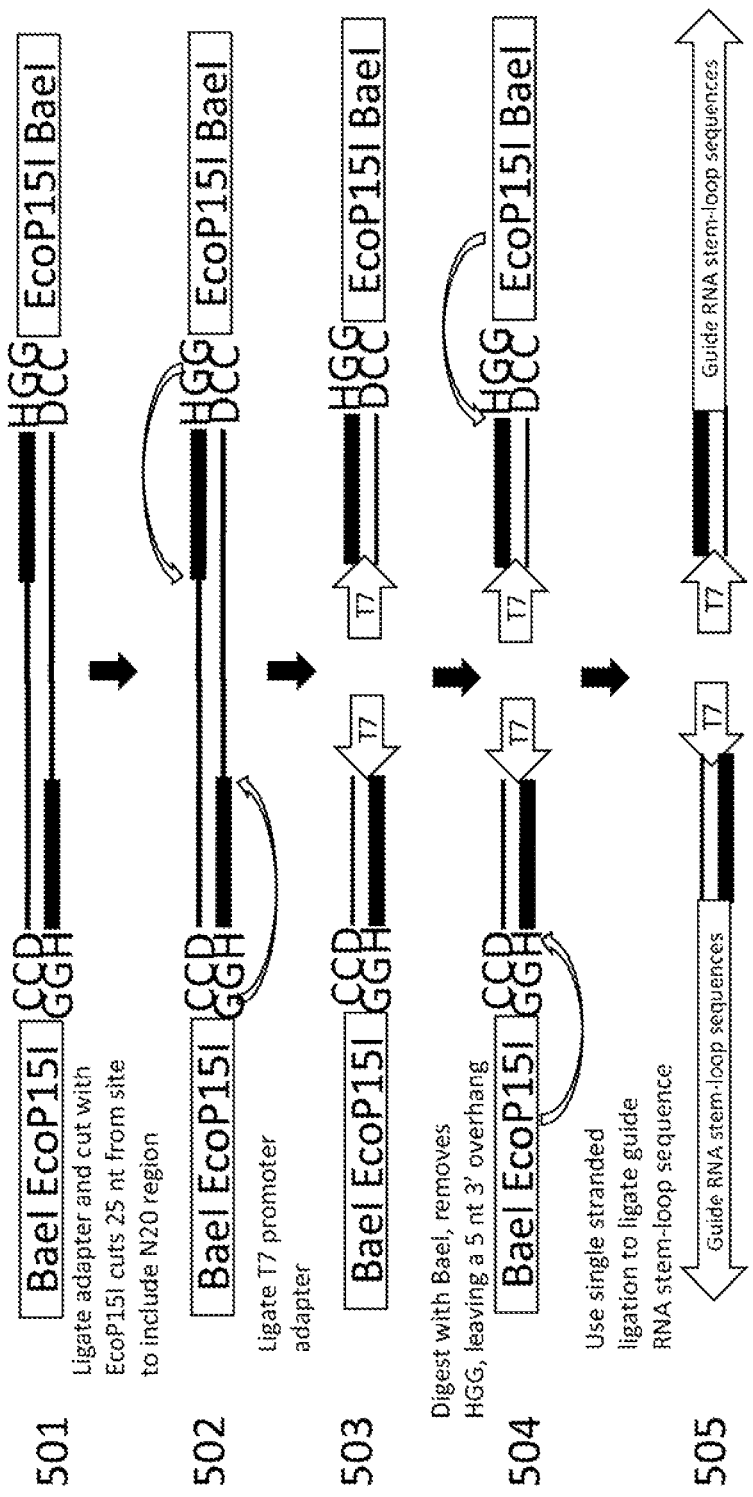
FIG. 5 illustrates an exemplary scheme for sequential production of a library of gNAs using one adapter and one oligo.

Alternatively, the protocol shown in FIG. 5 can follow the end of a protocol such as that shown in FIG. 3. Adapters with a recognition site for a nuclease enzyme that cleaves 25 nucleotides from the site (e.g., EcoP15I) can be ligated to the DNA 501. These adapters can also include a second recognition site for a nuclease that cuts the proper number of nucleotides from the site to later remove the first recognition site (e.g., BaeI) and any other left-over sequence, such as HGG. The enzyme corresponding to the first recognition site (e.g., EcoP15I) can then be used to cleave after the N20 sequence 502. Then, a promoter adapter (e.g., T7) can be ligated next to the N20 sequence 503. The enzyme corresponding to the second recognition site (e.g., BaeI) can then be used to remove the recognition sites and any residual sequence (e.g., HGG) 504. Finally, the guide RNA stem-loop sequence adapter can be ligated (e.g., by single strand ligation) to the N20 sequence 505.

Figure 6:
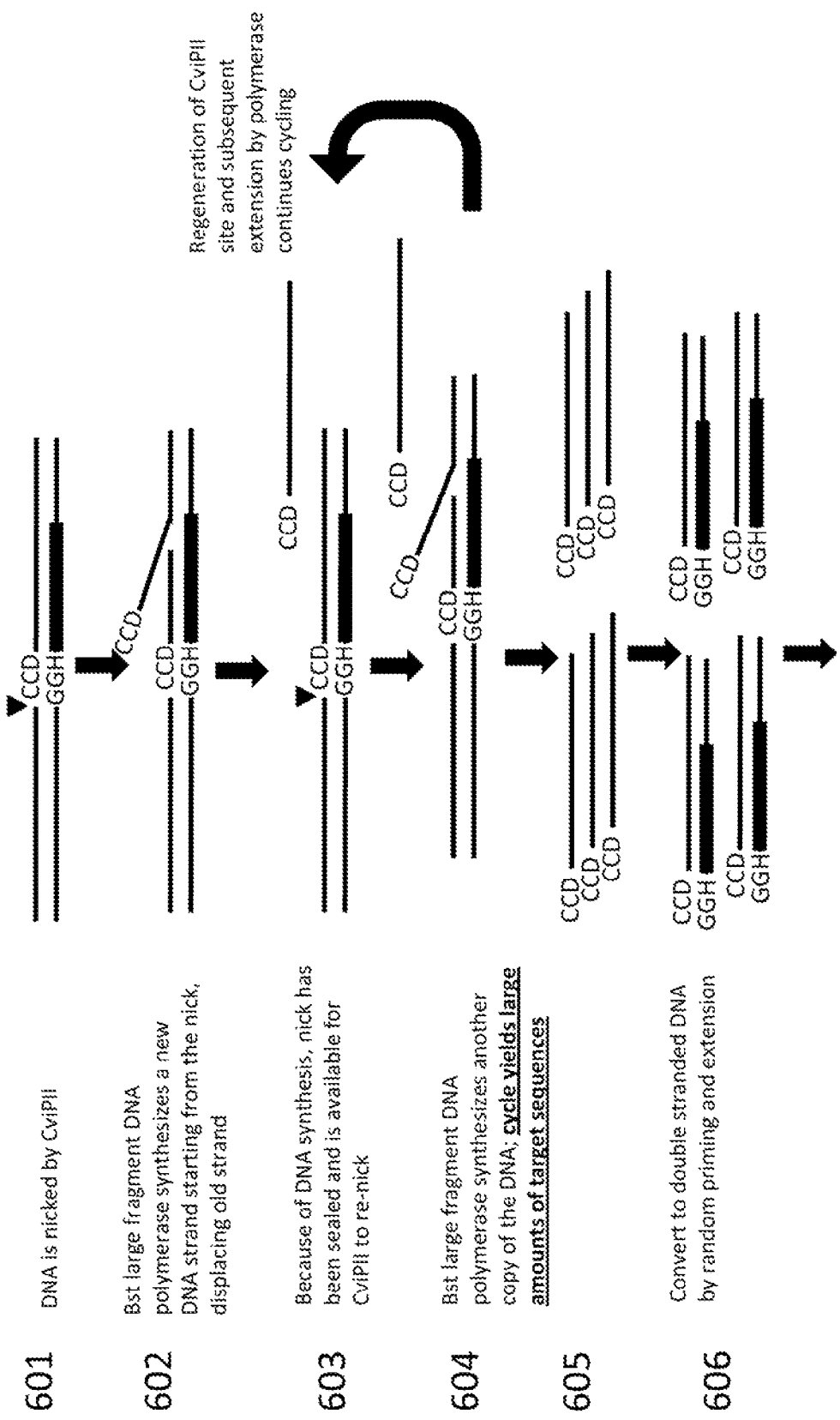
FIG. 6 illustrates an exemplary scheme for generation of a large pool of DNA fragments with blunt ends using Nicking Enzyme Mediated DNA Amplification (NEMDA).

As an alternative to protocols such as that shown in FIG. 3, the protocol shown in FIG. 6 can be used in preparation for protocols such as those shown in FIG. 4 or FIG. 5. A nick can be introduced by a nicking enzyme (e.g., CviPII) 601. In some cases, the nick recognition site is three or fewer bases in length. In some cases, CviPII is used, which can recognize and nick at a sequence of CCD. A polymerase (e.g., Bst large fragment DNA polymerase) can then be used to synthesize a new DNA strand starting from the nick while displacing the old strand 602. Because of the DNA synthesis, the nick can be sealed and made available to be nicked again 603. Subsequent cycles of nicking and synthesis can be used to yield large amounts of target sequences 604. These single stranded copies of target sequences can be made double stranded, for example by random priming and extension. These double stranded nucleic acids comprising N20 sequences can then be further processed by methods disclosed herein, such as those shown in FIG. 4 or FIG. 5.

Figure 7:
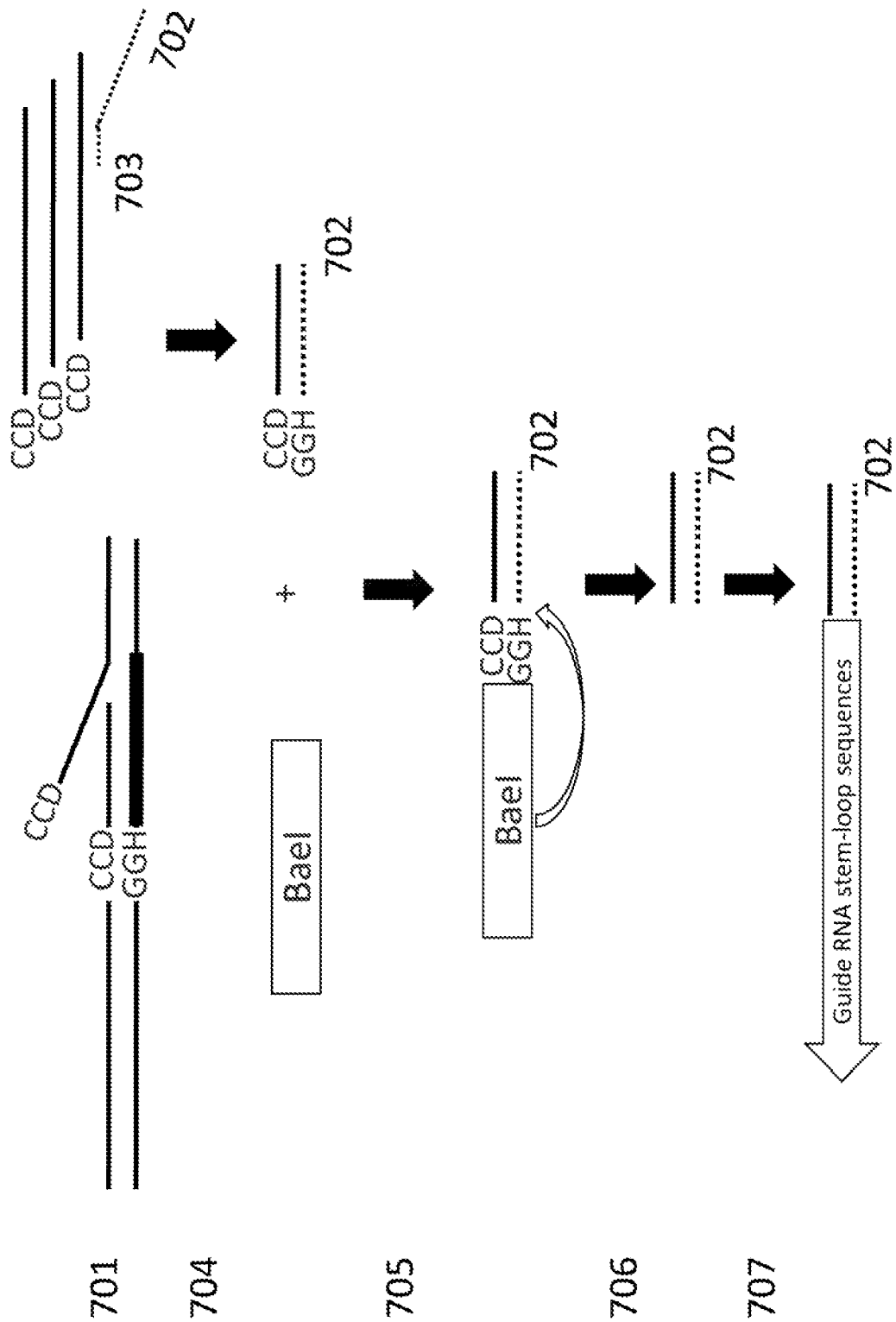
FIG. 7 illustrates an exemplary scheme for generation of a large pool of gNAs using Nicking Enzyme Mediated DNA Amplification (NEMDA).

As another alternative to protocols such as that shown in FIG. 3 or FIG. 6, the protocol shown in FIG. 7 can be used in preparation for protocols such as those shown in FIG. 4 or FIG. 5. A nick can be introduced by a nicking enzyme (e.g., CviPII) 701. In some cases, the nicking enzyme recognition site is three or fewer bases in length. In some cases, CviPII is used, which can recognize and nick at a sequence of CCD. A polymerase (e.g., Bst large fragment DNA polymerase) can then be used to synthesize a new DNA strand starting from the nick while displacing the old strand (e.g., nicking endonuclease-mediated strand-displacement DNA amplification (NEMDA)). The reaction parameters can be adjusted to control the size of the single stranded DNA produced. For example, the nickase:polymerase ratio (e.g., CviPII:Bts large fragment polymerase ratio) can be adjusted. Reaction temperature can also be adjusted. Next, an oligonucleotide can be added 704 which has (in the 5'>3' direction) a promoter (e.g., T7 promoter) 702 followed by a random n-mer (e.g., random 6-mer, random 8-mer) 703. The random n-mer region can bind to a region of the single stranded DNA generated previously. For example, binding can be conducted by denaturing at high temperature followed by rapid cool down, which can allow the random n-mer region to bind to the single stranded DNA generated by NEMDA. In some cases, the DNA is denatured at 98° C. for 7 minutes then cooled down rapidly to 10° C. Extension and/or amplification can be used to produce double-stranded DNA. Blunt ends can be produced, for example enzymatically (e.g., by treatment with DNA polymerase I at 20° C.). This can result in one end ending at the promoter (e.g., T7 promoter) and the other end ending at any nicking enzyme recognition sites (e.g., any CCD sites). These fragments can then be purified, for example by size selection (e.g., by gel purification, capillary electrophoresis, or other fragment separation techniques). In some cases, the target fragments are about 50 base pairs in length (adapter sequence (e.g., T7 adapter)+target N20 sequence+nicking enzyme recognition site or complement (e.g., HGG)). Fragments can then be ligated to an adapter comprising a nuclease recognition site for a nuclease that cuts an appropriate distance away to remove the nicking enzyme recognition site 705. For example, for a three-nucleotide long nicking enzyme recognition site (e.g., CCD for CviPII), BaeI can be used. The appropriate nuclease (e.g., BaeI) can then be used to remove the nuclease recognition site and the nicking enzyme recognition site 706. The remaining nucleic acid sequence (e.g., the N20 site) can then be ligated to the final stem-loop sequence for the guide RNA 707. Amplification (e.g., PCR) can be conducted. Guide RNAs can be produced.

In some embodiments, a collection of gNAs (e.g., gRNAs) targeting human mitochondrial DNA (mtDNA) is created, that can be used for directing nucleic acid-guided nuclease (e.g., Cas9) proteins, comprising the nucleic acid-guided nuclease (e.g., Cas9) target sequence. In some embodiments, the targeting sequence of this collection of gNAs (e.g., gRNAs) are encoded by DNA sequences comprising at least the 20 nt sequence provided in the second column from the right of Table 3 (if the NGG sequence is on positive strand) and Table 4 (if the NGG sequence is on negative strand). In some embodiments, a collection of gRNA nucleic acids, as provided herein, with specificity for human mitochondrial DNA, comprise a plurality of members, wherein the members comprise a plurality of targeting sequences provided in the second column from the right column of Table 3 and/or the second column from the right of Table 4.

TABLE 3 gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 13 | 35 | ATCACCCTATTAACCACTCACGG | 13 | ATCACCCTATTAACCACTCA | 436 |
| 14 | 36 | TCACCCTATTAACCACTCACGGG | 14 | TCACCCTATTAACCACTCAC | 437 |
| 32 | 54 | ACGGGAGCTCTCCATGCATTTGG | 15 | ACGGGAGCTCTCCATGCATT | 438 |
| 45 | 67 | ATGCATTTGGTATTTTCGTCTGG | 16 | ATGCATTTGGTATTTTCGTC | 439 |
| 46 | 68 | TGCATTTGGTATTTTCGTCTGGG | 17 | TGCATTTGGTATTTTCGTCT | 440 |
| 47 | 69 | GCATTTGGTATTTTCGTCTGGGG | 18 | GCATTTGGTATTTTCGTCTG | 441 |
| 48 | 70 | CATTTGGTATTTTCGTCTGGGGG | 19 | CATTTGGTATTTTCGTCTGG | 442 |
| 49 | 71 | ATTTGGTATTTTCGTCTGGGGG | 20 | ATTTGGTATTTTCGTCTGGG | 443 |
| 79 | 101 | GCGATAGCATTGCGAGACGCTGG | 21 | GCGATAGCATTGCGAGACGC | 444 |
| 85 | 107 | GCATTGCGAGACGCTGGAGCCGG | 22 | GCATTGCGAGACGCTGGAGC | 445 |
| 163 | 185 | GCACCTACGTTCAATATTACAGG | 23 | GCACCTACGTTCAATATTAC | 446 |
| 207 | 229 | GTTAATTAATTAATGCTTGTAGG | 24 | GTTAATTAATTAATGCTTGT | 447 |
| 301 | 323 | AACCCCCCCTCCCCCGCTTCTGG | 25 | AACCCCCCCTCCCCCGCTTC | 448 |
| 388 | 410 | AGATTTCAAATTTTATCTTTTGG | 26 | AGATTTCAAATTTTATCTTT | 449 |
| 391 | 413 | TTTCAAATTTTATCTTTTGGCGG | 27 | TTTCAAATTTTATCTTTTGG | 450 |
| 604 | 626 | ATACACTGAAAATGTTTAGACGG | 28 | ATACACTGAAAATGTTTAGA | 451 |
| 605 | 627 | TACACTGAAAATGTTTAGACGGG | 29 | TACACTGAAAATGTTTAGAC | 452 |
| 631 | 653 | ACATCACCCCATAAACAAATAGG | 30 | ACATCACCCCATAAACAAAT | 453 |
| 636 | 658 | ACCCCATAAACAAATAGGTTTGG | 31 | ACCCCATAAACAAATAGGTT | 454 |
| 727 | 749 | TCTAAATCACCACGATCAAAAGG | 32 | TCTAAATCACCACGATCAAA | 455 |
| 788 | 810 | TTAGCCTAGCCACACCCCACGG | 33 | TTAGCCTAGCCACACCCCA | 456 |
| 789 | 811 | TAGCCTAGCCACACCCCACGGG | 34 | TAGCCTAGCCACACCCCCAC | 457 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 851 | 873 | AACTAAGCTATACTAACCCCAGG | 35 | AACTAAGCTATACTAACCCC | 458 |
| 852 | 874 | ACTAAGCTATACTAACCCAGGG | 36 | ACTAAGCTATACTAACCCCA | 459 |
| 856 | 878 | AGCTATACTAACCCCAGGGTTGG | 37 | AGCTATACTAACCCCAGGGT | 460 |
| 880 | 902 | CAATTTCGTGCCAGCCACCGCGG | 38 | CAATTTCGTGCCAGCCACCG | 461 |
| 912 | 934 | TAACCCAAGTCAATAGAAGCCGG | 39 | TAACCCAAGTCAATAGAAGC | 462 |
| 1009 | 1031 | CACAAAATAGACTACGAAAGTGG | 40 | CACAAAATAGACTACGAAAG | 463 |
| 1051 | 1073 | ACAATAGCTAAGACCCAAACTGG | 41 | ACAATAGCTAAGACCCAAAC | 464 |
| 1052 | 1074 | CAATAGCTAAGACCCAAACTGGG | 42 | CAATAGCTAAGACCCAAACT | 465 |
| 1148 | 1170 | AGCCACAGCTTAAAACTCAAAGG | 43 | AGCCACAGCTTAAAACTCAA | 466 |
| 1154 | 1176 | AGCTTAAAACTCAAAGGACCTGG | 44 | AGCTTAAAACTCAAAGGACC | 467 |
| 1157 | 1179 | TTAAAACTCAAAGGACCTGGCGG | 45 | TTAAAACTCAAAGGACCTGG | 468 |
| 1178 | 1200 | GGTGCTTCATATCCCTCTAGAGG | 46 | GGTGCTTCATATCCCTCTAG | 469 |
| 1267 | 1289 | TCTTCAGCAAACCCTGATGAAGG | 47 | TCTTCAGCAAACCCTGATGA | 470 |
| 1306 | 1328 | AGTACCCACGTAAAGACGTTAGG | 48 | AGTACCCACGTAAAGACGTT | 471 |
| 1312 | 1334 | CACGTAAAGACGTTAGGTCAAGG | 49 | CACGTAAAGACGTTAGGTCA | 472 |
| 1326 | 1348 | AGGTCAAGGTGTAGCCCATGAGG | 50 | AGGTCAAGGTGTAGCCCATG | 473 |
| 1329 | 1351 | TCAAGGTGTAGCCCATGAGGTGG | 51 | TCAAGGTGTAGCCCATGAGG | 474 |
| 1339 | 1361 | GCCCATGAGGTGGCAAGAAATGG | 52 | GCCCATGAGGTGGCAAGAAA | 475 |
| 1340 | 1362 | CCCATGAGGTGGCAAGAAATGGG | 53 | CCCATGAGGTGGCAAGAAAT | 476 |
| 1389 | 1411 | GATAGCCCTTATGAAACTTAAGG | 54 | GATAGCCCTTATGAAACTTA | 477 |
| 1390 | 1412 | ATAGCCCTTATGAAACTTAAGGG | 55 | ATAGCCCTTATGAAACTTAA | 478 |
| 1397 | 1419 | TTATGAAACTTAAGGGTCGAAGG | 56 | TTATGAAACTTAAGGGTCGA | 479 |
| 1400 | 1422 | TGAAACTTAAGGGTCGAAGGTGG | 57 | TGAAACTTAAGGGTCGAAGG | 480 |
| 1441 | 1463 | AGTAGAGTGCTTAGTTGAACAGG | 58 | AGTAGAGTGCTTAGTTGAAC | 481 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 1442 | 1464 | GTAGAGTGCTTAGTTGAACAGGG | 59 | GTAGAGTGCTTAGTTGAACA | 482 |
| 1494 | 1516 | CCTCCTCAAGTATACTTCAAAGG | 60 | CCTCCTCAAGTATACTTCAA | 483 |
| 1530 | 1552 | ACCCCTACGCATTTATATAGAGG | 61 | ACCCCTACGCATTTATATAG | 484 |
| 1548 | 1570 | AGAGGAGACAAGTCGTAACATGG | 62 | AGAGGAGACAAGTCGTAACA | 485 |
| 1560 | 1582 | TCGTAACATGGTAAGTGTACTGG | 63 | TCGTAACATGGTAAGTGTAC | 486 |
| 1573 | 1595 | AGTGTACTGGAAAGTGCACTTGG | 64 | AGTGTACTGGAAAGTGCACT | 487 |
| 1620 | 1642 | AAAGCACCCAACTTACACTTAGG | 65 | AAAGCACCCAACTTACACTT | 488 |
| 1726 | 1748 | CATTTACCCAAATAAAGTATAGG | 66 | CATTTACCCAAATAAAGTAT | 489 |
| 1746 | 1768 | AGGCGATAGAAATTGAAACCTGG | 67 | AGGCGATAGAAATTGAAACC | 490 |
| 1770 | 1792 | GCAATAGATATAGTACCGCAAGG | 68 | GCAATAGATATAGTACCGCA | 491 |
| 1771 | 1793 | CAATAGATATAGTACCGCAAGGG | 69 | CAATAGATATAGTACCGCAA | 492 |
| 1809 | 1831 | TAACCAAGCATAATATAGCAAGG | 70 | TAACCAAGCATAATATAGCA | 493 |
| 1862 | 1884 | TAACTAGAAATAACTTTGCAAGG | 71 | TAACTAGAAATAACTTTGCA | 494 |
| 1947 | 1969 | CCGTCTATGTAGCAAAATAGTGG | 72 | CCGTCTATGTAGCAAAATAG | 495 |
| 1948 | 1970 | CGTCTATGTAGCAAAATAGTGGG | 73 | CGTCTATGTAGCAAAATAGT | 496 |
| 1960 | 1982 | AAAATAGTGGGAAGATTTATAGG | 74 | AAAATAGTGGGAAGATTTAT | 497 |
| 1966 | 1988 | GTGGGAAGATTTATAGGTAGAGG | 75 | GTGGGAAGATTTATAGGTAG | 498 |
| 1987 | 2009 | GGCGACAAACCTACCGAGCCTGG | 76 | GGCGACAAACCTACCGAGCC | 499 |
| 1997 | 2019 | CTACCGAGCCTGGTGATAGCTGG | 77 | CTACCGAGCCTGGTGATAGC | 500 |
| 2086 | 2108 | ATTTAACTGTTAGTCCAAAGAGG | 78 | ATTTAACTGTTAGTCCAAAG | 501 |
| 2099 | 2121 | TCCAAAGAGGAACAGCTCTTTGG | 79 | TCCAAAGAGGAACAGCTCTT | 502 |
| 2107 | 2129 | GGAACAGCTCTTTGGACACTAGG | 80 | GGAACAGCTCTTTGGACACT | 503 |
| 2152 | 2174 | AAAAATTTAACACCCATAGTAGG | 81 | AAAAATTTAACACCCATAGT | 504 |
| 2247 | 2269 | CTGAACTCCTCACACCCAATTGG | 82 | CTGAACTCCTCACACCCAAT | 505 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 2414 | 2436 | CCTCACTGTCAACCCAACACAGG | 83 | CCTCACTGTCAACCCAACAC | 506 |
| 2427 | 2449 | CCAACACAGGCATGCTCATAAGG | 84 | CCAACACAGGCATGCTCATA | 507 |
| 2432 | 2454 | ACAGGCATGCTCATAAGAAAGG | 85 | ACAGGCATGCTCATAAGGAA | 508 |
| 2449 | 2471 | GAAAGGTTAAAAAAGTAAAAGG | 86 | GAAAGGTTAAAAAAAGTAAA | 509 |
| 2456 | 2478 | TAAAAAAGTAAAAGGAACTCGG | 87 | TAAAAAAGTAAAAGGAACT | 510 |
| 2515 | 2537 | TCTAGCATCACCAGTATTAGAGG | 88 | TCTAGCATCACCAGTATTAG | 511 |
| 2546 | 2568 | GCCCAGTGACACATGTTTAACGG | 89 | GCCCAGTGACACATGTTTAA | 512 |
| 2552 | 2574 | TGACACATGTTTAACGGCCGCGG | 90 | TGACACATGTTTAACGGCCG | 513 |
| 2571 | 2593 | GCGGTACCCTAACCGTGCAAAGG | 91 | GCGGTACCCTAACCGTGCAA | 514 |
| 2599 | 2621 | TAATCACTTGTTCCTTAAATAGG | 92 | TAATCACTTGTTCCTTAAAT | 515 |
| 2600 | 2622 | AATCACTTGTTCCTTAAATAGGG | 93 | AATCACTTGTTCCTTAAATA | 516 |
| 2614 | 2636 | TAAATAGGGACCTGTATGAATGG | 94 | TAAATAGGGACCTGTATGAA | 517 |
| 2624 | 2646 | CCTGTATGAATGGCTCCACGAGG | 95 | CCTGTATGAATGGCTCCACG | 518 |
| 2625 | 2647 | CTGTATGAATGGCTCCACGAGGG | 96 | CTGTATGAATGGCTCCACGA | 519 |
| 2676 | 2698 | AAATTGACCTGCCCGTGAAGAGG | 97 | AAATTGACCTGCCCGTGAAG | 520 |
| 2679 | 2701 | TTGACCTGCCCGTGAAGAGGCGG | 98 | TTGACCTGCCCGTGAAGAGG | 521 |
| 2680 | 2702 | TGACCTGCCCGTGAAGAGGCGGG | 99 | TGACCTGCCCGTGAAGAGGC | 522 |
| 2711 | 2733 | AGCAAGACGAGAAGACCCTATGG | 100 | AGCAAGACGAGAAGACCCTA | 523 |
| 2755 | 2777 | ACAGTACCTAACAAACCCACAGG | 101 | ACAGTACCTAACAAACCCAC | 524 |
| 2789 | 2811 | CAAACCTGCATTAAAAATTTCGG | 102 | CAAACCTGCATTAAAAATTT | 525 |
| 2793 | 2815 | CCTGCATTAAAAATTTCGGTTGG | 103 | CCTGCATTAAAAATTTCGGT | 526 |
| 2794 | 2816 | CTGCATTAAAAATTTCGGTTGGG | 104 | CTGCATTAAAAATTTCGGTT | 527 |
| 2795 | 2817 | TGCATTAAAAATTTCGGTTGGGG | 105 | TGCATTAAAAATTTCGGTTG | 528 |
| 2804 | 2826 | AATTTCGGTTGGGGCGACCTCGG | 106 | AATTTCGGTTGGGGCGACCT | 529 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 2895 | 2917 | TGATCCAATAACTTGACCAACGG | 107 | TGATCCAATAACTTGACCAA | 530 |
| 2911 | 2933 | CCAACGGAACAAGTTACCCTAGG | 108 | CCAACGGAACAAGTTACCCT | 531 |
| 2912 | 2934 | CAACGGAACAAGTTACCCTAGGG | 109 | CAACGGAACAAGTTACCCTA | 532 |
| 2954 | 2976 | CTAGAGTCCATATCAACAATAGG | 110 | CTAGAGTCCATATCAACAAT | 533 |
| 2955 | 2977 | TAGAGTCCATATCAACAATAGGG | 111 | TAGAGTCCATATCAACAATA | 534 |
| 2974 | 2996 | AGGGTTTACGACCTCGATGTTGG | 112 | AGGGTTTACGACCTCGATGT | 535 |
| 2980 | 3002 | TACGACCTCGATGTTGGATCAGG | 113 | TACGACCTCGATGTTGGATC | 536 |
| 2992 | 3014 | GTTGGATCAGGACATCCCGATGG | 114 | GTTGGATCAGGACATCCCGA | 537 |
| 3010 | 3032 | GATGGTGCAGCCGCTATTAAAGG | 115 | GATGGTGCAGCCGCTATTAA | 538 |
| 3058 | 3080 | TACGTGATCTGAGTTCAGACCGG | 116 | TACGTGATCTGAGTTCAGAC | 539 |
| 3069 | 3091 | AGTTCAGACCGGAGTAATCCAGG | 117 | AGTTCAGACCGGAGTAATCC | 540 |
| 3073 | 3095 | CAGACCGGAGTAATCCAGGTCGG | 118 | CAGACCGGAGTAATCCAGGT | 541 |
| 3110 | 3132 | CAAATTCCTCCCTGTACGAAAGG | 119 | CAAATTCCTCCCTGTACGAA | 542 |
| 3125 | 3147 | ACGAAAGGACAAGAGAAATAAGG | 120 | ACGAAAGGACAAGAGAAATA | 543 |
| 3203 | 3225 | ACCCACACCCACCCAAGAACAGG | 121 | ACCCACACCCACCCAAGAAC | 544 |
| 3204 | 3226 | CCCACACCCACCCAAGAACAGGG | 122 | CCCACACCCACCCAAGAACA | 545 |
| 3217 | 3239 | AAGAACAGGGTTTGTTAAGATGG | 123 | AAGAACAGGGTTTGTTAAGA | 546 |
| 3227 | 3249 | TTTGTTAAGATGGCAGAGCCCGG | 124 | TTTGTTAAGATGGCAGAGCC | 547 |
| 3262 | 3284 | ACTTAAAACTTTACAGTCAGAGG | 125 | ACTTAAAACTTTACAGTCAG | 548 |
| 3294 | 3316 | TCTTCTTAACAACATACCCATGG | 126 | TCTTCTTAACAACATACCCA | 549 |
| 3336 | 3358 | TGTACCCATTCTAATCGCAATGG | 127 | TGTACCCATTCTAATCGCAA | 550 |
| 3370 | 3392 | CTTACCGAACGAAAAATTCTAGG | 128 | CTTACCGAACGAAAAATTCT | 551 |
| 3391 | 3413 | GGCTATATACAACTACGCAAAGG | 129 | GGCTATATACAACTACGCAA | 552 |
| 3406 | 3428 | CGCAAAGGCCCCAACGTTGTAGG | 130 | CGCAAAGGCCCCAACGTTGT | 553 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 3415 | 3437 | CCCAACGTTGTAGGCCCCTACGG | 131 | CCCAACGTTGTAGGCCCCTA | 554 |
| 3416 | 3438 | CCAACGTTGTAGGCCCCTACGGG | 132 | CCAACGTTGTAGGCCCCTAC | 555 |
| 3570 | 3592 | CCTCCCCATACCCAACCCCTGG | 133 | CCTCCCCATACCCAACCCCC | 556 |
| 3586 | 3608 | CCCCTGGTCAACCTCAACCTAGG | 134 | CCCCTGGTCAACCTCAACCT | 557 |
| 3643 | 3665 | GTTTACTCAATCCTCTGATCAGG | 135 | GTTTACTCAATCCTCTGATC | 558 |
| 3644 | 3666 | TTTACTCAATCCTCTGATCAGGG | 136 | TTTACTCAATCCTCTGATCA | 559 |
| 3676 | 3698 | AACTCAAACTACGCCCTGATCGG | 137 | AACTCAAACTACGCCCTGAT | 560 |
| 3757 | 3779 | CTATCAACATTACTAATAAGTGG | 138 | CTATCAACATTACTAATAAG | 561 |
| 3828 | 3850 | ACTCCTGCCATCATGACCCTTGG | 139 | ACTCCTGCCATCATGACCCT | 562 |
| 3892 | 3914 | ACCCCCTTCGACCTTGCCGAAGG | 140 | ACCCCCTTCGACCTTGCCGA | 563 |
| 3893 | 3915 | CCCCCTTCGACCTTGCCGAAGGG | 141 | CCCCCTTCGACCTTGCCGAA | 564 |
| 3894 | 3916 | CCCCTTCGACCTTGCCGAAGGGG | 142 | CCCCTTCGACCTTGCCGAAG | 565 |
| 3913 | 3935 | GGGGAGTCCGAACTAGTCTCAGG | 143 | GGGGAGTCCGAACTAGTCTC | 566 |
| 3937 | 3959 | TTCAACATCGAATACGCCGCAGG | 144 | TTCAACATCGAATACGCCGC | 567 |
| 4015 | 4037 | CTCACCACTACAATCTTCCTAGG | 145 | CTCACCACTACAATCTTCCT | 568 |
| 4287 | 4309 | ACTTTGATAGAGTAAATAATAGG | 146 | ACTTTGATAGAGTAAATAAT | 569 |
| 4311 | 4333 | GCTTAAACCCCCTTATTCTAGG | 147 | GCTTAAACCCCCTTATTTCT | 570 |
| 4386 | 4408 | TCACACCCCATCCTAAAGTAAGG | 148 | TCACACCCCATCCTAAAGTA | 571 |
| 4406 | 4428 | AGGTCAGCTAAATAAGCTATCGG | 149 | AGGTCAGCTAAATAAGCTAT | 572 |
| 4407 | 4429 | GGTCAGCTAAATAAGCTATCGGG | 150 | GGTCAGCTAAATAAGCTATC | 573 |
| 4428 | 4450 | GGCCCATACCCCGAAAATGTTGG | 151 | GGCCCATACCCCGAAAATGT | 574 |
| 4460 | 4482 | TCCCGTACTAATTAATCCCTGG | 152 | TCCCGTACTAATTAATCCCC | 575 |
| 4494 | 4516 | ATCTACTCTACCATCTTTGCAGG | 153 | ATCTACTCTACCATCTTTGC | 576 |
| 4542 | 4564 | CACTGATTTTTTACCTGAGTAGG | 154 | CACTGATTTTTTACCTGAGT | 577 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 4692 | 4714 | CTCTTCAACAATATACTCTCCGG | 155 | CTCTTCAACAATATACTCTC | 578 |
| 4767 | 4789 | ATAGCTATAGCAATAAAACTAGG | 156 | ATAGCTATAGCAATAAAACT | 579 |
| 4799 | 4821 | CTTTCACTTCTGAGTCCCAGAGG | 157 | CTTTCACTTCTGAGTCCCAG | 580 |
| 4809 | 4831 | TGAGTCCCAGAGGTTACCCAAGG | 158 | TGAGTCCCAGAGGTTACCCA | 581 |
| 4827 | 4849 | CAAGGCACCCCTCTGACATCCGG | 159 | CAAGGCACCCCTCTGACATC | 582 |
| 4941 | 4963 | TCAATCTTATCCATCATAGCAGG | 160 | TCAATCTTATCCATCATAGC | 583 |
| 4950 | 4972 | TCCATCATAGCAGGCAGTTGAGG | 161 | TCCATCATAGCAGGCAGTTG | 584 |
| 4953 | 4975 | ATCATAGCAGGCAGTTGAGGTGG | 162 | ATCATAGCAGGCAGTTGAGG | 585 |
| 5010 | 5032 | TACTCCTCAATTACCCACATAGG | 163 | TACTCCTCAATTACCCACAT | 586 |
| 5202 | 5224 | CCATCCACCCTCCTCTCCCTAGG | 164 | CCATCCACCCTCCTCTCCCT | 587 |
| 5205 | 5227 | TCCACCCTCCTCTCCCTAGGAGG | 165 | TCCACCCTCCTCTCCCTAGG | 588 |
| 5223 | 5245 | GGAGGCCTGCCCCCGCTAACCGG | 166 | GGAGGCCTGCCCCCGCTAAC | 589 |
| 5239 | 5261 | TAACCGGCTTTTTGCCCAAATGG | 167 | TAACCGGCTTTTTGCCCAAA | 590 |
| 5240 | 5262 | AACCGGCTTTTTGCCCAATGGG | 168 | AACCGGCTTTTTGCCCAAAT | 591 |
| 5500 | 5522 | TAATAATCTTATAGAAATTTAGG | 169 | TAATAATCTTATAGAAATTT | 592 |
| 5569 | 5591 | CTTAATTTCTGTAACAGCTAAGG | 170 | CTTAATTTCTGTAACAGCTA | 593 |
| 5646 | 5668 | CTAAGCCCTTACTAGACCAATGG | 171 | CTAAGCCCTTACTAGACCAA | 594 |
| 5647 | 5669 | TAAGCCCTTACTAGACCAATGGG | 172 | TAAGCCCTTACTAGACCAAT | 595 |
| 5697 | 5719 | AGCTAAGCACCCTAATCAACTGG | 173 | AGCTAAGCACCCTAATCAAC | 596 |
| 5723 | 5745 | CAATCTACTTCTCCCGCCGCCGG | 174 | CAATCTACTTCTCCCGCCGC | 597 |
| 5724 | 5746 | AATCTACTTCTCCCGCCGCCGGG | 175 | AATCTACTTCTCCCGCCGCC | 598 |
| 5732 | 5754 | TCTCCCGCCGCCGGGAAAAAAGG | 176 | TCTCCCGCCGCCGGGAAAA | 599 |
| 5735 | 5757 | CCCGCCGCCGGGAAAAAAGGCGG | 177 | CCCGCCGCCGGGAAAAAAGG | 600 |
| 5736 | 5758 | CCGCCGCCGGGAAAAAAGGCGGG | 178 | CCGCCGCCGGGAAAAAAGGC | 601 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 5747 | 5769 | AAAAAAGGCGGGAGAAGCCCCGG | 179 | AAAAAAGGCGGGAGAAGCCC | 602 |
| 5751 | 5773 | AAGGCGGGAGAAGCCCCGGCAGG | 180 | AAGGCGGGAGAAGCCCCGGC | 603 |
| 5800 | 5822 | ATTCAATATGAAAATCACCTCGG | 181 | ATTCAATATGAAAATCACCT | 604 |
| 5806 | 5828 | TATGAAAATCACCTCGGAGCTGG | 182 | TATGAAAATCACCTCGGAGC | 605 |
| 5816 | 5838 | ACCTCGGAGCTGGTAAAAGAGG | 183 | ACCTCGGAGCTGGTAAAAAG | 606 |
| 5928 | 5950 | TCTACAAACCACAAAGACATTGG | 184 | TCTACAAACCACAAAGACAT | 607 |
| 5949 | 5971 | GGAACACTATACCTATTATTCGG | 185 | GGAACACTATACCTATTATT | 608 |
| 5961 | 5983 | CTATTATTCGGCGCATGAGCTGG | 186 | CTATTATTCGGCGCATGAGC | 609 |
| 5970 | 5992 | GGCGCATGAGCTGGAGTCCTAGG | 187 | GGCGCATGAGCTGGAGTCCT | 610 |
| 6005 | 6027 | CCTCCTTATTCGAGCCGAGCTGG | 188 | CCTCCTTATTCGAGCCGAGC | 611 |
| 6006 | 6028 | CTCCTTATTCGAGCCGAGCTGGG | 189 | CTCCTTATTCGAGCCGAGCT | 612 |
| 6027 | 6049 | GGCCAGCCAGGCAACCTTCTAGG | 190 | GGCCAGCCAGGCAACCTTCT | 613 |
| 6108 | 6130 | ATAGTAATACCCATCATAATCGG | 191 | ATAGTAATACCCATCATAAT | 614 |
| 6111 | 6133 | GTAATACCCATCATAATCGGAGG | 192 | GTAATACCCATCATAATCGG | 615 |
| 6117 | 6139 | CCCATCATAATCGGAGGCTTTGG | 193 | CCCATCATAATCGGAGGCTT | 616 |
| 6144 | 6166 | TGACTAGTTCCCCTAATAATCGG | 194 | TGACTAGTTCCCCTAATAAT | 617 |
| 6158 | 6180 | AATAATCGGTGCCCCGATATGG | 195 | AATAATCGGTGCCCCCGATA | 618 |
| 6236 | 6258 | CCTGCTCGCATCTGCTATAGTGG | 196 | CCTGCTCGCATCTGCTATAG | 619 |
| 6239 | 6261 | GCTCGCATCTGCTATAGTGGAGG | 197 | GCTCGCATCTGCTATAGTGG | 620 |
| 6243 | 6265 | GCATCTGCTATAGTGGAGGCCGG | 198 | GCATCTGCTATAGTGGAGGC | 621 |
| 6249 | 6271 | GCTATAGTGGAGGCCGGAGCAGG | 199 | GCTATAGTGGAGGCCGGAGC | 622 |
| 6255 | 6277 | GTGGAGGCCGGAGCAGGAACAGG | 200 | GTGGAGGCCGGAGCAGGAAC | 623 |
| 6282 | 6304 | ACAGTCTACCCTCCCTTAGCAGG | 201 | ACAGTCTACCCTCCCTTAGC | 624 |
| 6283 | 6305 | CAGTCTACCCTCCCTTAGCAGGG | 202 | CAGTCTACCCTCCCTTAGCA | 625 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 6300 | 6322 | GCAGGGAACTACTCCCACCCTGG | 203 | GCAGGGAACTACTCCCACCC | 626 |
| 6342 | 6364 | ATCTTCTCCTTACACCTAGCAGG | 204 | ATCTTCTCCTTACACCTAGC | 627 |
| 6360 | 6382 | GCAGGTGTCTCCTCTATCTTAGG | 205 | GCAGGTGTCTCCTCTATCTT | 628 |
| 6361 | 6383 | CAGGTGTCTCCTCTATCTTAGGG | 206 | CAGGTGTCTCCTCTATCTTA | 629 |
| 6362 | 6384 | AGGTGTCTCCTCTATCTTAGGGG | 207 | AGGTGTCTCCTCTATCTTAG | 630 |
| 6495 | 6517 | TCTCTCCCAGTCCTAGCTGCTGG | 208 | TCTCTCCCAGTCCTAGCTGC | 631 |
| 6552 | 6574 | ACCACCTTCTTCGACCCCGCCGG | 209 | ACCACCTTCTTCGACCCCGC | 632 |
| 6555 | 6577 | ACCTTCTTCGACCCCGCCGGAGG | 210 | ACCTTCTTCGACCCCGCCGG | 633 |
| 6558 | 6580 | TTCTTCGACCCCGCCGGAGGAGG | 211 | TTCTTCGACCCCGCCGGAGG | 634 |
| 6597 | 6619 | CAACACCTATTCTGATTTTTCGG | 212 | CAACACCTATTCTGATTTTT | 635 |
| 6630 | 6652 | GTTTATATTCTTATCCTACCAGG | 213 | GTTTATATTCTTATCCTACC | 636 |
| 6636 | 6658 | ATTCTTATCCTACCAGGCTTCGG | 214 | ATTCTTATCCTACCAGGCTT | 637 |
| 6669 | 6691 | CATATTGTAACTTACTACTCCGG | 215 | CATATTGTAACTTACTACTC | 638 |
| 6687 | 6709 | TCCGGAAAAAAGAACCATTTGG | 216 | TCCGGAAAAAAGAACCATT | 639 |
| 6696 | 6718 | AAAGAACCATTTGGATACATAGG | 217 | AAAGAACCATTTGGATACAT | 640 |
| 6701 | 6723 | ACCATTTGGATACATAGGTATGG | 218 | ACCATTTGGATACATAGGTA | 641 |
| 6723 | 6745 | GTCTGAGCTATGATATCAATTGG | 219 | GTCTGAGCTATGATATCAAT | 642 |
| 6732 | 6754 | ATGATATCAATTGGCTTCCTAGG | 220 | ATGATATCAATTGGCTTCCT | 643 |
| 6733 | 6755 | TGATATCAATTGGCTTCCTAGGG | 221 | TGATATCAATTGGCTTCCTA | 644 |
| 6768 | 6790 | GCACACCATATATTTACAGTAGG | 222 | GCACACCATATATTTACAGT | 645 |
| 6831 | 6853 | ATAATCATCGCTATCCCCACCGG | 223 | ATAATCATCGCTATCCCCAC | 646 |
| 6867 | 6889 | AGCTGACTCGCCACACTCCACGG | 224 | AGCTGACTCGCCACACTCCA | 647 |
| 6909 | 6931 | GCTGCAGTGCTCTGAGCCCTAGG | 225 | GCTGCAGTGCTCTGAGCCCT | 648 |
| 6933 | 6955 | TTCATCTTTCTTTTCACCGTAGG | 226 | TTCATCTTTCTTTTCACCGT | 649 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 6936 | 6958 | ATCTTTCTTTTCACCGTAGGTGG | 227 | ATCTTTCTTTTCACCGTAGG | 650 |
| 6945 | 6967 | TTCACCGTAGGTGGCCTGACTGG | 228 | TTCACCGTAGGTGGCCTGAC | 651 |
| 7032 | 7054 | TTCCACTATGTCCTATCAATAGG | 229 | TTCCACTATGTCCTATCAAT | 652 |
| 7053 | 7075 | GGAGCTGTATTTGCCATCATAGG | 230 | GGAGCTGTATTTGCCATCAT | 653 |
| 7056 | 7078 | GCTGTATTTGCCATCATAGGAGG | 231 | GCTGTATTTGCCATCATAGG | 654 |
| 7086 | 7108 | CACTGATTTCCCCTATTCTCAGG | 232 | CACTGATTTCCCCTATTCTC | 655 |
| 7140 | 7162 | CATTTCACTATCATATTCATCGG | 233 | CATTTCACTATCATATTCAT | 656 |
| 7176 | 7198 | TTCTTCCCACAACACTTTCTCGG | 234 | TTCTTCCCACAACACTTTCT | 657 |
| 7185 | 7207 | CAACACTTTCTCGGCCTATCCGG | 235 | CAACACTTTCTCGGCCTATC | 658 |
| 7205 | 7227 | CGGAATGCCCCGACGTTACTCGG | 236 | CGGAATGCCCCGACGTTACT | 659 |
| 7251 | 7273 | TGAAACATCCTATCATCTGTAGG | 237 | TGAAACATCCTATCATCTGT | 660 |
| 7358 | 7380 | AGAAGAACCCTCCATAAACCTGG | 238 | AGAAGAACCCTCCATAAACC | 661 |
| 7371 | 7393 | ATAAACCTGGAGTGACTATATGG | 239 | ATAAACCTGGAGTGACTATA | 662 |
| 7432 | 7454 | ACATAAAATCTAGACAAAAAGG | 240 | ACATAAAATCTAGACAAAAA | 663 |
| 7436 | 7458 | AAAATCTAGACAAAAAGGAAGG | 241 | AAAATCTAGACAAAAAGGA | 664 |
| 7457 | 7479 | GGAATCGAACCCCCCAAAGCTGG | 242 | GGAATCGAACCCCCCAAAGC | 665 |
| 7476 | 7498 | CTGGTTTCAAGCCAACCCATGG | 243 | CTGGTTTCAAGCCAACCCCA | 666 |
| 7499 | 7521 | CCTCCATGACTTTTTCAAAAGG | 244 | CCTCCATGACTTTTTCAAAA | 667 |
| 7544 | 7566 | CTTTGTCAAAGTTAAATTATAGG | 245 | CTTTGTCAAAGTTAAATTAT | 668 |
| 7567 | 7589 | CTAAATCCTATATATCTTAATGG | 246 | CTAAATCCTATATATCTTAA | 669 |
| 7586 | 7608 | ATGGCACATGCAGCGCAAGTAGG | 247 | ATGGCACATGCAGCGCAAGT | 670 |
| 7741 | 7763 | TACTAACATCTCAGACGCTCAGG | 248 | TACTAACATCTCAGACGCTC | 671 |
| 7831 | 7853 | CATCCTTTACATAACAGACGAGG | 249 | CATCCTTTACATAACAGACG | 672 |
| 7865 | 7887 | TCCCTTACCATCAAATCAATTGG | 250 | TCCCTTACCATCAAATCAAT | 673 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 7875 | 7897 | TCAAATCAATTGGCCACCAATGG | 251 | TCAAATCAATTGGCCACCAA | 674 |
| 7904 | 7926 | ACCTACGAGTACACCGACTACGG | 252 | ACCTACGAGTACACCGACTA | 675 |
| 7907 | 7929 | TACGAGTACACCGACTACGGCGG | 253 | TACGAGTACACCGACTACGG | 676 |
| 7955 | 7977 | CCCCCATTATTCCTAGAACCAGG | 254 | CCCCCATTATTCCTAGAACC | 677 |
| 8069 | 8091 | TCATGAGCTGTCCCCACATTAGG | 255 | TCATGAGCTGTCCCCACATT | 678 |
| 8093 | 8115 | TTAAAAACAGATGCAATTCCCGG | 256 | TTAAAAACAGATGCAATTCC | 679 |
| 8131 | 8153 | CACTTTCACCGCTACACGACCGG | 257 | CACTTTCACCGCTACACGAC | 680 |
| 8132 | 8154 | ACTTTCACCGCTACACGACCGGG | 258 | ACTTTCACCGCTACACGACC | 681 |
| 8133 | 8155 | CTTTCACCGCTACACGACCGGGG | 259 | CTTTCACCGCTACACGACCG | 682 |
| 8134 | 8156 | TTTCACCGCTACACGACCGGGGG | 260 | TTTCACCGCTACACGACCGG | 683 |
| 8144 | 8166 | ACACGACCGGGGGTATACTACGG | 261 | ACACGACCGGGGGTATACTA | 684 |
| 8165 | 8187 | GGTCAATGCTCTGAAATCTGTGG | 262 | GGTCAATGCTCTGAAATCTG | 685 |
| 8228 | 8250 | CCCCTAAAAATCTTTGAAATAGG | 263 | CCCCTAAAAATCTTTGAAAT | 686 |
| 8229 | 8251 | CCCTAAAAATCTTTGAAATAGGG | 264 | CCCTAAAAATCTTTGAAATA | 687 |
| 8370 | 8392 | CCCAACTAAATACTACCGTATGG | 265 | CCCAACTAAATACTACCGTA | 688 |
| 8551 | 8573 | TTCATTGCCCCCACAATCCTAGG | 266 | TTCATTGCCCCCACAATCCT | 689 |
| 8698 | 8720 | ATAACCATACACAACACTAAAGG | 267 | ATAACCATACACAACACTAA | 690 |
| 8761 | 8783 | ATTGCCACAACTAACCTCCTCGG | 268 | ATTGCCACAACTAACCTCCT | 691 |
| 8817 | 8839 | ACTATCTATAAACCTAGCCATGG | 269 | ACTATCTATAAACCTAGCCA | 692 |
| 8835 | 8857 | CATGGCCATCCCCTTATGAGCGG | 270 | CATGGCCATCCCCTTATGAG | 693 |
| 8836 | 8858 | ATGGCCATCCCCTTATGAGCGGG | 271 | ATGGCCATCCCCTTATGAGC | 694 |
| 8851 | 8873 | TGAGCGGGCACAGTGATTATAGG | 272 | TGAGCGGGCACAGTGATTAT | 695 |
| 8899 | 8921 | CTAGCCCACTTCTTACCACAAGG | 273 | CTAGCCCACTTCTTACCACA | 696 |
| 8973 | 8995 | ACTCATTCAACCAATAGCCCTGG | 274 | ACTCATTCAACCAATAGCCC | 697 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 9004 | 9026 | CTAACCGCTAACATTACTGCAGG | 275 | CTAACCGCTAACATTACTGC | 698 |
| 9028 | 9050 | CACCTACTCATGCACCTAATTGG | 276 | CACCTACTCATGCACCTAAT | 699 |
| 9243 | 9265 | CCCAGCCCATGACCCCTAACAGG | 277 | CCCAGCCCATGACCCCTAAC | 700 |
| 9244 | 9266 | CCAGCCCATGACCCCTACAGGG | 278 | CCAGCCCATGACCCCTAACA | 701 |
| 9245 | 9267 | CAGCCCATGACCCCTAACAGGGG | 279 | CAGCCCATGACCCCTAACAG | 702 |
| 9273 | 9295 | TCAGCCCTCCTAATGACCTCCGG | 280 | TCAGCCCTCCTAATGACCTC | 703 |
| 9321 | 9343 | TCCATAACGCTCCTCATACTAGG | 281 | TCCATAACGCTCCTCATACT | 704 |
| 9358 | 9380 | CACTAACCATATACCAATGATGG | 282 | CACTAACCATATACCAATGA | 705 |
| 9390 | 9412 | ACACGAGAAAGCACATACCAAGG | 283 | ACACGAGAAAGCACATACCA | 706 |
| 9417 | 9439 | CACACACCACCTGTCCAAAAAGG | 284 | CACACACCACCTGTCCAAAA | 707 |
| 9429 | 9451 | GTCCAAAAAGGCCTTCGATACGG | 285 | GTCCAAAAAGGCCTTCGATA | 708 |
| 9430 | 9452 | TCCAAAAAGGCCTTCGATACGGG | 286 | TCCAAAAAGGCCTTCGATAC | 709 |
| 9471 | 9493 | TCAGAAGTTTTTTTCTTCGCAGG | 287 | TCAGAAGTTTTTTTCTTCGC | 710 |
| 9522 | 9544 | CTAGCCCCTACCCCCCAATTAGG | 288 | CTAGCCCCTACCCCCCAATT | 711 |
| 9525 | 9547 | GCCCCTACCCCCCAATTAGGAGG | 289 | GCCCCTACCCCCCAATTAGG | 712 |
| 9526 | 9548 | CCCCTACCCCCCAATTAGGAGGG | 290 | CCCCTACCCCCCAATTAGGA | 713 |
| 9532 | 9554 | CCCCCCAATTAGGAGGGCACTGG | 291 | CCCCCCAATTAGGAGGGCAC | 714 |
| 9543 | 9565 | GGAGGGCACTGGCCCCCAACAGG | 292 | GGAGGGCACTGGCCCCCAAC | 715 |
| 9606 | 9628 | ACATCCGTATTACTCGCATCAGG | 293 | ACATCCGTATTACTCGCATC | 716 |
| 9692 | 9714 | ACTGCTTATTACAATTTTACTGG | 294 | ACTGCTTATTACAATTTTAC | 717 |
| 9693 | 9715 | CTGCTTATTACAATTTTACTGGG | 295 | CTGCTTATTACAATTTTACT | 718 |
| 9756 | 9778 | TCTCCCTTCACCATTTCCGACGG | 296 | TCTCCCTTCACCATTTCCGA | 719 |
| 9765 | 9787 | ACCATTTCCGACGGCATCTACGG | 297 | ACCATTTCCGACGGCATCTA | 720 |
| 9789 | 9811 | TCAACATTTTTTGTAGCCACAGG | 298 | TCAACATTTTTTGTAGCCAC | 721 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 9798 | 9820 | TTTGTAGCCACAGGCTTCCACGG | 299 | TTTGTAGCCACAGGCTTCCA | 722 |
| 9816 | 9838 | CACGGACTTCACGTCATTATTGG | 300 | CACGGACTTCACGTCATTAT | 723 |
| 9885 | 9907 | TTTACATCCAAACATCACTTTGG | 301 | TTTACATCCAAACATCACTT | 724 |
| 9910 | 9932 | TCGAAGCCGCCGCCTGATACTGG | 302 | TCGAAGCCGCCGCCTGATAC | 725 |
| 9926 | 9948 | ATACTGGCATTTTGTAGATGTGG | 303 | ATACTGGCATTTTGTAGATG | 726 |
| 9963 | 9985 | TATGTCTCCATCTATTGATGAGG | 304 | TATGTCTCCATCTATTGATG | 727 |
| 9964 | 9986 | ATGTCTCCATCTATTGATGAGGG | 305 | ATGTCTCCATCTATTGATGA | 728 |
| 10122 | 10144 | TTTTGACTACCACAACTCAACGG | 306 | TTTTGACTACCACAACTCAA | 729 |
| 10155 | 10177 | AAATCCACCCCTTACGAGTGCGG | 307 | AAATCCACCCCTTACGAGTG | 730 |
| 10343 | 10365 | CATCATCCTAGCCCTAAGTCTGG | 308 | CATCATCCTAGCCCTAAGTC | 731 |
| 10365 | 10387 | GCCTATGAGTGACTACAAAAAGG | 309 | GCCTATGAGTGACTACAAAA | 732 |
| 10385 | 10407 | AGGATTAGACTGAACCGAATTGG | 310 | AGGATTAGACTGAACCGAAT | 733 |
| 10500 | 10522 | GCATTTACCATCTCACTTCTAGG | 311 | GCATTTACCATCTCACTTCT | 734 |
| 10551 | 10573 | TCCTCCCTACTATGCCTAGAAGG | 312 | TCCTCCCTACTATGCCTAGA | 735 |
| 10664 | 10686 | CTTTGCCGCCTGCGAAGCAGCGG | 313 | CTTTGCCGCCTGCGAAGCAG | 736 |
| 10667 | 10689 | TGCCGCCTGCGAAGCAGCGGTGG | 314 | TGCCGCCTGCGAAGCAGCGG | 737 |
| 10668 | 10690 | GCCGCCTGCGAAGCAGCGGTGGG | 315 | GCCGCCTGCGAAGCAGCGGT | 738 |
| 10704 | 10726 | GTCTCAATCTCCAACACATATGG | 316 | GTCTCAATCTCCAACACATA | 739 |
| 10972 | 10994 | ACTCCTACCCCTCACAATCATGG | 317 | ACTCCTACCCCTCACAATCA | 740 |
| 11128 | 11150 | AACCACACTTATCCCACCTTGG | 318 | AACCACACTTATCCCCACCT | 741 |
| 11147 | 11169 | TTGGCTATCATCACCCGATGAGG | 319 | TTGGCTATCATCACCCGATG | 742 |
| 11174 | 11196 | CAGCCAGAACGCCTGAACGCAGG | 320 | CAGCCAGAACGCCTGAACGC | 743 |
| 11204 | 11226 | TTCCTATTCTACACCCTAGTAGG | 321 | TTCCTATTCTACACCCTAGT | 744 |
| 11252 | 11274 | ATTTACACTCACAACACCCTAGG | 322 | ATTTACACTCACAACACCCT | 745 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 11369 | 11391 | ATAGTAAAGATACCTCTTTACGG | 323 | ATAGTAAAGATACCTCTTTA | 746 |
| 11417 | 11439 | CATGTCGAAGCCCCCATCGCTGG | 324 | CATGTCGAAGCCCCCATCGC | 747 |
| 11418 | 11440 | ATGTCGAAGCCCCCATCGCTGGG | 325 | ATGTCGAAGCCCCCATCGCT | 748 |
| 11453 | 11475 | GCCGCAGTACTCTTAAAACTAGG | 326 | GCCGCAGTACTCTTAAAACT | 749 |
| 11456 | 11478 | GCAGTACTCTTAAAACTAGGCGG | 327 | GCAGTACTCTTAAAACTAGG | 750 |
| 11462 | 11484 | CTCTTAAAACTAGGCGGCTATGG | 328 | CTCTTAAAACTAGGCGGCTA | 751 |
| 11540 | 11562 | TTCCTTGTACTATCCCTATGAGG | 329 | TTCCTTGTACTATCCCTATG | 752 |
| 11669 | 11691 | CAAACCCCTGAAGCTTCACCGG | 330 | CAAACCCCTGAAGCTTCAC | 753 |
| 11696 | 11718 | GTCATTCTCATAATCGCCACGG | 331 | GTCATTCTCATAATCGCCCA | 754 |
| 11697 | 11719 | TCATTCTCATAATCGCCCACGGG | 332 | TCATTCTCATAATCGCCCAC | 755 |
| 11777 | 11799 | CGCATCATAATCCTCTCTCAAGG | 333 | CGCATCATAATCCTCTCTCA | 756 |
| 11866 | 11888 | ACCCCCCACTATTAACCTACTGG | 334 | ACCCCCCACTATTAACCTAC | 757 |
| 11867 | 11889 | CCCCCCACTATTAACCTACTGGG | 335 | CCCCCCACTATTAACCTACT | 758 |
| 11927 | 11949 | AATATCACTCTCCTACTTACAGG | 336 | AATATCACTCTCCTACTTAC | 759 |
| 11985 | 12007 | ACATATTTACCACAACACAATGG | 337 | ACATATTTACCACAACACAA | 760 |
| 11986 | 12008 | CATATTTACCACAACACAATGGG | 338 | CATATTTACCACAACACAAT | 761 |
| 11987 | 12009 | ATATTTACCACAACACAATGGGG | 339 | ATATTTACCACAACACAATG | 762 |
| 12104 | 12126 | CTCAACCCCGACATCATTACCGG | 340 | CTCAACCCCGACATCATTAC | 763 |
| 12105 | 12127 | TCAACCCCGACATCATTACCGGG | 341 | TCAACCCCGACATCATTACC | 764 |
| 12164 | 12186 | GATTGTGAATCTGACAACAGAGG | 342 | GATTGTGAATCTGACAACAG | 765 |
| 12235 | 12257 | TGCCCCCATGTCTAACAACATGG | 343 | TGCCCCCATGTCTAACAACA | 766 |
| 12254 | 12276 | ATGGCTTTCTCAACTTTTAAAGG | 344 | ATGGCTTTCTCAACTTTTAA | 767 |
| 12272 | 12294 | AAAGGATAACAGCTATCCATTGG | 345 | AAAGGATAACAGCTATCCAT | 768 |
| 12279 | 12301 | AACAGCTATCCATTGGTCTTAGG | 346 | AACAGCTATCCATTGGTCTT | 769 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 12294 | 12316 | GTCTTAGGCCCCAAAAATTTTGG | 347 | GTCTTAGGCCCCAAAAATTT | 770 |
| 12608 | 12630 | CTGTAGCATTGTTCGTTACATGG | 348 | CTGTAGCATTGTTCGTTACA | 771 |
| 12742 | 12764 | AACCTATTCCAACTGTTCATCGG | 349 | AACCTATTCCAACTGTTCAT | 772 |
| 12750 | 12772 | CCAACTGTTCATCGGCTGAGAGG | 350 | CCAACTGTTCATCGGCTGAG | 773 |
| 12751 | 12773 | CAACTGTTCATCGGCTGAGAGGG | 351 | CAACTGTTCATCGGCTGAGA | 774 |
| 12757 | 12779 | TTCATCGGCTGAGAGGGCGTAGG | 352 | TTCATCGGCTGAGAGGGCGT | 775 |
| 12847 | 12869 | GCAATCCTATACAACCGTATCGG | 353 | GCAATCCTATACAACCGTAT | 776 |
| 12856 | 12878 | TACAACCGTATCGGCGATATCGG | 354 | TACAACCGTATCGGCGATAT | 777 |
| 12958 | 12980 | CCAAGCCTCACCCCACTACTAGG | 355 | CCAAGCCTCACCCCACTACT | 778 |
| 12979 | 13001 | GGCCTCCTCCTAGCAGCAGCAGG | 356 | GGCCTCCTCCTAGCAGCAGC | 779 |
| 12997 | 13019 | GCAGGCAAATCAGCCCAATTAGG | 357 | GCAGGCAAATCAGCCCAATT | 780 |
| 13030 | 13052 | TGACTCCCCTCAGCCATAGAAGG | 358 | TGACTCCCCTCAGCCATAGA | 781 |
| 13081 | 13103 | TCAAGCACTATAGTTGTAGCAGG | 359 | TCAAGCACTATAGTTGTAGC | 782 |
| 13156 | 13178 | CAAACTCTAACACTATGCTTAGG | 360 | CAAACTCTAACACTATGCTT | 783 |
| 13246 | 13268 | TTCTCCACTTCAAGTCAACTAGG | 361 | TTCTCCACTTCAAGTCAACT | 784 |
| 13267 | 13289 | GGACTCATAATAGTTACAATCGG | 362 | GGACTCATAATAGTTACAAT | 785 |
| 13345 | 13367 | GCCATACTATTTATGTGCTCCGG | 363 | GCCATACTATTTATGTGCTC | 786 |
| 13346 | 13368 | CCATACTATTTATGTGCTCCGGG | 364 | CCATACTATTTATGTGCTCC | 787 |
| 13393 | 13415 | GAACAAGATATTCGAAAAATAGG | 365 | GAACAAGATATTCGAAAAAT | 788 |
| 13396 | 13418 | CAAGATATTCGAAAAATAGGAGG | 366 | CAAGATATTCGAAAAATAGG | 789 |
| 13441 | 13463 | ACTTCAACCTCCCTCACCATTGG | 367 | ACTTCAACCTCCCTCACCAT | 790 |
| 13459 | 13481 | ATTGGCAGCCTAGCATTAGCAGG | 368 | ATTGGCAGCCTAGCATTAGC | 791 |
| 13477 | 13499 | GCAGGAATACCTTTCCTCACAGG | 369 | GCAGGAATACCTTTCCTCAC | 792 |
| 13612 | 13634 | ATAATTCTTCTCACCCTAACAGG | 370 | ATAATTCTTCTCACCCTAAC | 793 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 13686 | 13708 | ACTAAACCCCATTAAACGCCTGG | 371 | ACTAAACCCCATTAAACGCC | 794 |
| 13693 | 13715 | CCCATTAAACGCCTGGCAGCCGG | 372 | CCCATTAAACGCCTGGCAGC | 795 |
| 13708 | 13730 | GCAGCCGGAAGCCTATTCGCAGG | 373 | GCAGCCGGAAGCCTATTCGC | 796 |
| 13804 | 13826 | GCCCTCGCTGTCACTTTCCTAGG | 374 | GCCCTCGCTGTCACTTTCCT | 797 |
| 13894 | 13916 | TTTTATTTCTCCAACATACTCGG | 375 | TTTTATTTCTCCAACATACT | 798 |
| 13936 | 13958 | CACCGCACAATCCCCTATCTAGG | 376 | CACCGCACAATCCCCTATCT | 799 |
| 14059 | 14081 | ATCATCACCTCAACCCAAAAAGG | 377 | ATCATCACCTCAACCCAAAA | 800 |
| 14237 | 14259 | TACAAAGCCCCCGCACCAATAGG | 378 | TACAAAGCCCCCGCACCAAT | 801 |
| 14417 | 14439 | ACCCCTGACCCCCATGCCTCAGG | 379 | ACCCCTGACCCCCATGCCTC | 802 |
| 14579 | 14601 | AATACTAAACCCCCATAAATAGG | 380 | AATACTAAACCCCCATAAAT | 803 |
| 14585 | 14607 | AAACCCCCATAAATAGGAGAAGG | 381 | AAACCCCCATAAATAGGAGA | 804 |
| 14664 | 14686 | CATACATCATTATTCTCGCACGG | 382 | CATACATCATTATTCTCGCA | 805 |
| 14825 | 14847 | ATCTCCGCATGATGAAACTTCGG | 383 | ATCTCCGCATGATGAAACTT | 806 |
| 14837 | 14859 | TGAAACTTCGGCTCACTCCTTGG | 384 | TGAAACTTCGGCTCACTCCT | 807 |
| 14867 | 14889 | CTGATCCTCCAAATCACCACAGG | 385 | CTGATCCTCCAAATCACCAC | 808 |
| 14951 | 14973 | ATCACTCGAGACGTAAATTATGG | 386 | ATCACTCGAGACGTAAATTA | 809 |
| 14981 | 15003 | ATCCGCTACCTTCACGCCAATGG | 387 | ATCCGCTACCTTCACGCCAA | 810 |
| 15020 | 15042 | ATCTGCCTCTTCCTACACATCGG | 388 | ATCTGCCTCTTCCTACACAT | 811 |
| 15021 | 15043 | TCTGCCTCTTCCTACACATCGGG | 389 | TCTGCCTCTTCCTACACATC | 812 |
| 15026 | 15048 | CTCTTCCTACACATCGGGCGAGG | 390 | CTCTTCCTACACATCGGGCG | 813 |
| 15038 | 15060 | ATCGGGCGAGGCCTATATTACGG | 391 | ATCGGGCGAGGCCTATATTA | 814 |
| 15071 | 15093 | TACTCAGAAACCTGAAACATCGG | 392 | TACTCAGAAACCTGAAACAT | 815 |
| 15113 | 15135 | ACTATAGCAACAGCCTTCATAGG | 393 | ACTATAGCAACAGCCTTCAT | 816 |
| 15131 | 15153 | ATAGGCTATGTCCTCCCGTGAGG | 394 | ATAGGCTATGTCCTCCCGTG | 817 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 15149 | 15171 | TGAGGCCAAATATCATTCTGAGG | 395 | TGAGGCCAAATATCATTCTG | 818 |
| 15150 | 15172 | GAGGCCAAATATCATTCTGAGGG | 396 | GAGGCCAAATATCATTCTGA | 819 |
| 15151 | 15173 | AGGCCAAATATCATTCTGAGGGG | 397 | AGGCCAAATATCATTCTGAG | 820 |
| 15194 | 15216 | CTATCCGCCATCCCATACATTGG | 398 | CTATCCGCCATCCCATACAT | 821 |
| 15195 | 15217 | TATCCGCCATCCCATACATTGGG | 399 | TATCCGCCATCCCATACATT | 822 |
| 15221 | 15243 | GACCTAGTTCAATGAATCTGAGG | 400 | GACCTAGTTCAATGAATCTG | 823 |
| 15224 | 15246 | CTAGTTCAATGAATCTGAGGAGG | 401 | CTAGTTCAATGAATCTGAGG | 824 |
| 15334 | 15356 | CCTCCTATTCTTGCACGAAACGG | 402 | CCTCCTATTCTTGCACGAAA | 825 |
| 15335 | 15357 | CTCCTATTCTTGCACGAAACGGG | 403 | CTCCTATTCTTGCACGAAAC | 826 |
| 15353 | 15375 | ACGGGATCAAACAACCCCTAGG | 404 | ACGGGATCAAACAACCCCT | 827 |
| 15416 | 15438 | TACACAATCAAAGACGCCCTCGG | 405 | TACACAATCAAAGACGCCCT | 828 |
| 15476 | 15498 | CTATTCTCACCAGACCTCCTAGG | 406 | CTATTCTCACCAGACCTCCT | 829 |
| 15590 | 15612 | CGATCCGTCCCTAACAAACTAGG | 407 | CGATCCGTCCCTAACAAACT | 830 |
| 15593 | 15615 | TCCGTCCCTAACAAACTAGGAGG | 408 | TCCGTCCCTAACAAACTAGG | 831 |
| 15740 | 15762 | CTCCTCATTCTAACCTGAATCGG | 409 | CTCCTCATTCTAACCTGAAT | 832 |
| 15743 | 15765 | CTCATTCTAACCTGAATCGGAGG | 410 | CTCATTCTAACCTGAATCGG | 833 |
| 15776 | 15798 | AGCTACCCTTTTACCATCATTGG | 411 | AGCTACCCTTTTACCATCAT | 834 |
| 15861 | 15883 | TTGAAAACAAAATACTCAAATGG | 412 | TTGAAAACAAAATACTCAAA | 835 |
| 15862 | 15884 | TGAAAACAAAATACTCAAATGGG | 413 | TGAAAACAAAATACTCAAAT | 836 |
| 15906 | 15928 | AATACACCAGTCTTGTAAACCGG | 414 | AATACACCAGTCTTGTAAAC | 837 |
| 15928 | 15950 | GAGATGAAAACCTTTTTCCAAGG | 415 | GAGATGAAAACCTTTTTCCA | 838 |
| 16012 | 16034 | AACTATTCTCTGTTCTTTCATGG | 416 | AACTATTCTCTGTTCTTTCA | 839 |
| 16013 | 16035 | ACTATTCTCTGTTCTTTCATGGG | 417 | ACTATTCTCTGTTCTTTCAT | 840 |
| 16014 | 16036 | CTATTCTCTGTTCTTTCATGGGG | 418 | CTATTCTCTGTTCTTTCATG | 841 |

TABLE 3-continued gRNA target sequence for human mtDNA carrying NGG sequence on the (+) strand.

| Chr start position (+ strand) | Chr end position (+ strand) | nt sequence on the (+) strand containing gRNA target sequence followed by NGG | SEQ ID NO | 20 nt gRNA target sequence (will encode the gRNA targeting sequence) | SEQ ID NO |
|---|---|---|---|---|---|
| 16026 | 16048 | CTTTCATGGGGAAGCAGATTTGG | 419 | CTTTCATGGGGAAGCAGATT | 842 |
| 16027 | 16049 | TTTCATGGGGAAGCAGATTTGGG | 420 | TTTCATGGGGAAGCAGATTT | 843 |
| 16108 | 16130 | CAGCCACCATGAATATTGTACGG | 421 | CAGCCACCATGAATATTGTA | 844 |
| 16252 | 16274 | AAAGCCACCCCTCACCCACTAGG | 422 | AAAGCCACCCCTCACCCACT | 845 |
| 16348 | 16370 | CAAATCCCTTCTCGTCCCCATGG | 423 | CAAATCCCTTCTCGTCCCCA | 846 |
| 16367 | 16389 | ATGGATGACCCCCCTCAGATAGG | 424 | ATGGATGACCCCCCTCAGAT | 847 |
| 16368 | 16390 | TGGATGACCCCCCTCAGATAGGG | 425 | TGGATGACCCCCCTCAGATA | 848 |
| 16369 | 16391 | GGATGACCCCCCTCAGATAGGGG | 426 | GGATGACCCCCCTCAGATAG | 849 |
| 16434 | 16456 | GAGTGCTACTCTCCTCGCTCCGG | 427 | GAGTGCTACTCTCCTCGCTC | 850 |
| 16435 | 16457 | AGTGCTACTCTCCTCGCTCCGGG | 428 | AGTGCTACTCTCCTCGCTCC | 851 |
| 16449 | 16471 | CGCTCCGGGCCCATAACACTTGG | 429 | CGCTCCGGGCCCATAACACT | 852 |
| 16450 | 16472 | GCTCCGGGCCCATAACACTTGGG | 430 | GCTCCGGGCCCATAACACTT | 853 |
| 16451 | 16473 | CTCCGGGCCCATAACACTTGGGG | 431 | CTCCGGGCCCATAACACTTG | 854 |
| 16452 | 16474 | TCCGGGCCCATAACACTTGGGGG | 432 | TCCGGGCCCATAACACTTGG | 855 |
| 16482 | 16504 | AGTGAACTGTATCCGACATCTGG | 433 | AGTGAACTGTATCCGACATC | 856 |
| 16495 | 16517 | CGACATCTGGTTCCTACTTCAGG | 434 | CGACATCTGGTTCCTACTTC | 857 |
| 16496 | 16518 | GACATCTGGTTCCTACTTCAGGG | 435 | GACATCTGGTTCCTACTTCA | 858 |

TABLE 4 gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 17 | 39 | CCCTATTAACCACTCACGGGAGC | 859 | GCTCCCGTGAGTGGTTAATA | 2628 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 18 | 40 | CCTATTAACCACTCACGGGAGCT | 860 | AGCTCCCGTGAGTGGTTAAT | 2629 |
| 26 | 48 | CCACTCACGGGAGCTCTCCATGC | 861 | GCATGGAGAGCTCCCGTGAG | 2630 |
| 43 | 65 | CCATGCATTTGGTATTTTCGTCT | 862 | AGACGAAAATACCAAATGCA | 2631 |
| 104 | 126 | CCGGAGCACCCTATGTCGCAGTA | 863 | TACTGCGACATAGGGTGCTC | 2632 |
| 112 | 134 | CCCTATGTCGCAGTATCTGTCTT | 864 | AAGACAGATACTGCGACATA | 2633 |
| 113 | 135 | CCTATGTCGCAGTATCTGTCTTT | 865 | AAAGACAGATACTGCGACAT | 2634 |
| 140 | 162 | CCTGCCTCATCCTATTATTTATC | 866 | GATAAATAATAGGATGAGGC | 2635 |
| 144 | 166 | CCTCATCCTATTATTTATCGCAC | 867 | GTGCGATAAATAATAGGATG | 2636 |
| 150 | 172 | CCTATTATTTATCGCACCTACGT | 868 | ACGTAGGTGCGATAAATAAT | 2637 |
| 166 | 188 | CCTACGTTCAATATTACAGGCGA | 869 | TCGCCTGTAATATTGAACGT | 2638 |
| 261 | 283 | CCACTTTCCACACAGACATCATA | 870 | TATGATGTCTGTGTGGAAAG | 2639 |
| 268 | 290 | CCACACAGACATCATAACAAAAA | 871 | TTTTTGTTATGATGTCTGTG | 2640 |
| 298 | 320 | CCAAACCCCCCCTCCCCCGCTTC | 872 | GAAGCGGGGGAGGGGGGGTT | 2641 |
| 304 | 326 | CCCCCCTCCCCCGCTTCTGGCCA | 873 | TGGCCAGAAGCGGGGGAGGG | 2642 |
| 305 | 327 | CCCCCTCCCCCGCTTCTGGCCAC | 874 | GTGGCCAGAAGCGGGGGAGG | 2643 |
| 306 | 328 | CCCCTCCCCCGCTTCTGGCCACA | 875 | TGTGGCCAGAAGCGGGGGAG | 2644 |
| 307 | 329 | CCCTCCCCCGCTTCTGGCCACAG | 876 | CTGTGGCCAGAAGCGGGGGA | 2645 |
| 308 | 330 | CCTCCCCCGCTTCTGGCCACAGC | 877 | GCTGTGGCCAGAAGCGGGGG | 2646 |
| 311 | 333 | CCCCCGCTTCTGGCCACAGCACT | 878 | AGTGCTGTGGCCAGAAGCGG | 2647 |
| 312 | 334 | CCCCGCTTCTGGCCACAGCACTT | 879 | AAGTGCTGTGGCCAGAAGCG | 2648 |
| 313 | 335 | CCCGCTTCTGGCCACAGCACTTA | 880 | TAAGTGCTGTGGCCAGAAGC | 2649 |
| 314 | 336 | CCGCTTCTGGCCACAGCACTTAA | 881 | TTAAGTGCTGTGGCCAGAAG | 2650 |
| 324 | 346 | CCACAGCACTTAAACACATCTCT | 882 | AGAGATGTGTTTAAGTGCTG | 2651 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 348 | 370 | CCAAACCCCAAAAACAAAGAACC | 883 | GGTTCTTTGTTTTTGGGGTT | 2652 |
| 353 | 375 | CCCCAAAAACAAAGAACCCTAAC | 884 | GTTAGGGTTCTTTGTTTTTG | 2653 |
| 354 | 376 | CCCAAAAACAAAGAACCCTAACA | 885 | TGTTAGGGTTCTTTGTTTTT | 2654 |
| 355 | 377 | CCAAAAACAAAGAACCCTAACAC | 886 | GTGTTAGGGTTCTTTGTTTT | 2655 |
| 369 | 391 | CCCTAACACCAGCCTAACCAGAT | 887 | ATCTGGTTAGGCTGGTGTTA | 2656 |
| 370 | 392 | CCTAACACCAGCCTAACCAGATT | 888 | AATCTGGTTAGGCTGGTGTT | 2657 |
| 377 | 399 | CCAGCCTAACCAGATTTCAAATT | 889 | AATTTGAAATCTGGTTAGGC | 2658 |
| 381 | 403 | CCTAACCAGATTTCAAATTTTAT | 890 | ATAAAATTTGAAATCTGGTT | 2659 |
| 386 | 408 | CCAGATTTCAAATTTTATCTTTT | 891 | AAAAGATAAAATTTGAAATC | 2660 |
| 433 | 455 | CCCCCCAACTAACACATTATTTT | 892 | AAAATAATGTGTTAGTTGGG | 2661 |
| 434 | 456 | CCCCCAACTAACACATTATTTTC | 893 | GAAAATAATGTGTTAGTTGG | 2662 |
| 435 | 457 | CCCCAACTAACACATTATTTTCC | 894 | GGAAAATAATGTGTTAGTTG | 2663 |
| 436 | 458 | CCCAACTAACACATTATTTTCCC | 895 | GGGAAAATAATGTGTTAGTT | 2664 |
| 437 | 459 | CCAACTAACACATTATTTTCCCC | 896 | GGGGAAAATAATGTGTTAGT | 2665 |
| 456 | 478 | CCCCTCCCACTCCCATACTACTA | 897 | TAGTAGTATGGGAGTGGGAG | 2666 |
| 457 | 479 | CCCTCCCACTCCCATACTACTAA | 898 | TTAGTAGTATGGGAGTGGGA | 2667 |
| 458 | 480 | CCTCCCACTCCCATACTACTAAT | 899 | ATTAGTAGTATGGGAGTGGG | 2668 |
| 461 | 483 | CCCACTCCCATACTACTAATCTC | 900 | GAGATTAGTAGTATGGGAGT | 2669 |
| 462 | 484 | CCACTCCCATACTACTAATCTCA | 901 | TGAGATTAGTAGTATGGGAG | 2670 |
| 467 | 489 | CCCATACTACTAATCTCATCAAT | 902 | ATTGATGAGATTAGTAGTAT | 2671 |
| 468 | 490 | CCATACTACTAATCTCATCAATA | 903 | TATTGATGAGATTAGTAGTA | 2672 |
| 494 | 516 | CCCCCGCCCATCCTACCCAGCAC | 904 | GTGCTGGGTAGGATGGGCGG | 2673 |
| 495 | 517 | CCCCGCCCATCCTACCCAGCACA | 905 | TGTGCTGGGTAGGATGGGCG | 2674 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 496 | 518 | CCCGCCCATCCTACCCAGCACAC | 906 | GTGTGCTGGGTAGGATGGGC | 2675 |
| 497 | 519 | CCGCCCATCCTACCCAGCACACA | 907 | TGTGTGCTGGGTAGGATGGG | 2676 |
| 500 | 522 | CCCATCCTACCCAGCACACACAC | 908 | GTGTGTGTGCTGGGTAGGAT | 2677 |
| 501 | 523 | CCATCCTACCCAGCACACACACA | 909 | TGTGTGTGTGCTGGGTAGGA | 2678 |
| 505 | 527 | CCTACCCAGCACACACACACCGC | 910 | GCGGTGTGTGTGCTGGGT | 2679 |
| 509 | 531 | CCCAGCACACACACACCGCTGCT | 911 | AGCAGCGGTGTGTGTGTGCT | 2680 |
| 510 | 532 | CCAGCACACACACACCGCTGCTA | 912 | TAGCAGCGGTGTGTGTGTGC | 2681 |
| 524 | 546 | CCGCTGCTAACCCCATACCCCGA | 913 | TCGGGGTATGGGGTTAGCAG | 2682 |
| 534 | 556 | CCCCATACCCCGAACCAACCAAA | 914 | TTTGGTTGGTTCGGGGTATG | 2683 |
| 535 | 557 | CCCATACCCCGAACCAACCAAAC | 915 | GTTTGGTTGGTTCGGGGTAT | 2684 |
| 536 | 558 | CCATACCCCGAACCAACCAAACC | 916 | GGTTTGGTTGGTTCGGGGTA | 2685 |
| 541 | 563 | CCCCGAACCAACCAAACCCCAAA | 917 | TTTGGGGTTTGGTTGGTTCG | 2686 |
| 542 | 564 | CCCGAACCAACCAAACCCCAAAG | 918 | CTTTGGGGTTTGGTTGGTTC | 2687 |
| 543 | 565 | CCGAACCAACCAAACCCCAAAGA | 919 | TCTTTGGGGTTTGGTTGGTT | 2688 |
| 548 | 570 | CCAACCAAACCCCAAAGACACCC | 920 | GGGTGTCTTTGGGGTTTGGT | 2689 |
| 552 | 574 | CCAAACCCCAAAGACACCCCCCA | 921 | TGGGGGGTGTCTTTGGGGTT | 2690 |
| 557 | 579 | CCCCAAAGACACCCCCCACAGTT | 922 | AACTGTGGGGGGTGTCTTTG | 2691 |
| 558 | 580 | CCCAAAGACACCCCCCACAGTTT | 923 | AAACTGTGGGGGGTGTCTTT | 2692 |
| 559 | 581 | CCAAAGACACCCCCCACAGTTTA | 924 | TAAACTGTGGGGGGTGTCTT | 2693 |
| 568 | 590 | CCCCCCACAGTTTATGTAGCTTA | 925 | TAAGCTACATAAACTGTGGG | 2694 |
| 569 | 591 | CCCCCACAGTTTATGTAGCTTAC | 926 | GTAAGCTACATAAACTGTGG | 2695 |
| 570 | 592 | CCCCACAGTTTATGTAGCTTACC | 927 | GGTAAGCTACATAAACTGTG | 2696 |
| 571 | 593 | CCCACAGTTTATGTAGCTTACCT | 928 | AGGTAAGCTACATAAACTGT | 2697 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 572 | 594 | CCACAGTTTATGTAGCTTACCTC | 929 | GAGGTAAGCTACATAAACTG | 2698 |
| 591 | 613 | CCTCCTCAAAGCAATACACTGAA | 930 | TTCAGTGTATTGCTTTGAGG | 2699 |
| 594 | 616 | CCTCAAAGCAATACACTGAAAAT | 931 | ATTTTCAGTGTATTGCTTTG | 2700 |
| 637 | 659 | CCCCATAAACAAATAGGTTTGGT | 932 | ACCAAACCTATTTGTTTATG | 2701 |
| 638 | 660 | CCCATAAACAAATAGGTTTGGTC | 933 | GACCAAACCTATTTGTTTAT | 2702 |
| 639 | 661 | CCATAAACAAATAGGTTTGGTCC | 934 | GGACCAAACCTATTTGTTTA | 2703 |
| 660 | 682 | CCTAGCCTTTCTATTAGCTCTTA | 935 | TAAGAGCTAATAGAAAGGCT | 2704 |
| 665 | 687 | CCTTTCTATTAGCTCTTAGTAAG | 936 | CTTACTAAGAGCTAATAGAA | 2705 |
| 705 | 727 | CCCCGTTCCAGTGAGTTCACCCT | 937 | AGGGTGAACTCACTGGAACG | 2706 |
| 706 | 728 | CCCGTTCCAGTGAGTTCACCCTC | 938 | GAGGGTGAACTCACTGGAAC | 2707 |
| 707 | 729 | CCGTTCCAGTGAGTTCACCCTCT | 939 | AGAGGGTGAACTCACTGGAA | 2708 |
| 712 | 734 | CCAGTGAGTTCACCCTCTAAATC | 940 | GATTTAGAGGGTGAACTCAC | 2709 |
| 724 | 746 | CCCTCTAAATCACCACGATCAAA | 941 | TTTGATCGTGGTGATTTAGA | 2710 |
| 725 | 747 | CCTCTAAATCACCACGATCAAAA | 942 | TTTTGATCGTGGTGATTTAG | 2711 |
| 736 | 758 | CCACGATCAAAAGGAACAAGCAT | 943 | ATGCTTGTTCCTTTTGATCG | 2712 |
| 792 | 814 | CCTAGCCACACCCCCACGGGAAA | 944 | TTTCCCGTGGGGGTGTGGCT | 2713 |
| 797 | 819 | CCACACCCCCACGGGAAACAGCA | 945 | TGCTGTTTCCCGTGGGGGTG | 2714 |
| 802 | 824 | CCCCCACGGGAAACAGCAGTGAT | 946 | ATCACTGCTGTTTCCCGTGG | 2715 |
| 803 | 825 | CCCCACGGGAAACAGCAGTGATT | 947 | AATCACTGCTGTTTCCCGTG | 2716 |
| 804 | 826 | CCCACGGGAAACAGCAGTGATTA | 948 | TAATCACTGCTGTTTCCCGT | 2717 |
| 805 | 827 | CCACGGGAAACAGCAGTGATTAA | 949 | TTAATCACTGCTGTTTCCCG | 2718 |
| 828 | 850 | CCTTTAGCAATAAACGAAAGTTT | 950 | AAACTTTCGTTTATTGCTAA | 2719 |
| 867 | 889 | CCCCAGGGTTGGTCAATTTCGTG | 951 | CACGAAATTGACCAACCCTG | 2720 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 868 | 890 | CCCAGGGTTGGTCAATTTCGTGC | 952 | GCACGAAATTGACCAACCCT | 2721 |
| 869 | 891 | CCAGGGTTGGTCAATTTCGTGCC | 953 | GGCACGAAATTGACCAACCC | 2722 |
| 890 | 912 | CCAGCCACCGCGGTCACACGATT | 954 | AATCGTGTGACCGCGGTGGC | 2723 |
| 894 | 916 | CCACCGCGGTCACACGATTAACC | 955 | GGTTAATCGTGTGACCGCGG | 2724 |
| 897 | 919 | CCGCGGTCACACGATTAACCCAA | 956 | TTGGGTTAATCGTGTGACCG | 2725 |
| 915 | 937 | CCCAAGTCAATAGAAGCCGGCGT | 957 | ACGCCGGCTTCTATTGACTT | 2726 |
| 916 | 938 | CCAAGTCAATAGAAGCCGGCGTA | 958 | TACGCCGGCTTCTATTGACT | 2727 |
| 931 | 953 | CCGGCGTAAAGAGTGTTTTAGAT | 959 | ATCTAAAACACTCTTTACGC | 2728 |
| 956 | 978 | CCCCCTCCCCAATAAAGCTAAAA | 960 | TTTTAGCTTTATTGGGAGG | 2729 |
| 957 | 979 | CCCCTCCCCAATAAAGCTAAAAC | 961 | GTTTTAGCTTTATTGGGGAG | 2730 |
| 958 | 980 | CCCTCCCCAATAAAGCTAAAACT | 962 | AGTTTTAGCTTTATTGGGA | 2731 |
| 959 | 981 | CCTCCCCAATAAAGCTAAAACTC | 963 | GAGTTTTAGCTTTATTGGGG | 2732 |
| 962 | 984 | CCCCAATAAAGCTAAAACTCACC | 964 | GGTGAGTTTTAGCTTTATTG | 2733 |
| 963 | 985 | CCCAATAAAGCTAAAACTCACCT | 965 | AGGTGAGTTTTAGCTTTATT | 2734 |
| 964 | 986 | CCAATAAAGCTAAAACTCACCTG | 966 | CAGGTGAGTTTTAGCTTTAT | 2735 |
| 983 | 1005 | CCTGAGTTGTAAAAAACTCCAGT | 967 | ACTGGAGTTTTTTACAACTC | 2736 |
| 1001 | 1023 | CCAGTTGACACAAAATAGACTAC | 968 | GTAGTCTATTTTGTGTCAAC | 2737 |
| 1064 | 1086 | CCCAAACTGGGATTAGATACCCC | 969 | GGGGTATCTAATCCCAGTTT | 2738 |
| 1065 | 1087 | CCAAACTGGGATTAGATACCCCA | 970 | TGGGGTATCTAATCCCAGTT | 2739 |
| 1083 | 1105 | CCCCACTATGCTTAGCCCTAAAC | 971 | GTTTAGGGCTAAGCATAGTG | 2740 |
| 1084 | 1106 | CCCACTATGCTTAGCCCTAAACC | 972 | GGTTTAGGGCTAAGCATAGT | 2741 |
| 1085 | 1107 | CCACTATGCTTAGCCCTAAACCT | 973 | AGGTTTAGGGCTAAGCATAG | 2742 |
| 1098 | 1120 | CCCTAAACCTCAACAGTTAAATC | 974 | GATTTAACTGTTGAGGTTTA | 2743 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 1099 | 1121 | CCTAAACCTCAACAGTTAAATCA | 975 | TGATTTAACTGTTGAGGTTT | 2744 |
| 1105 | 1127 | CCTCAACAGTTAAATCAACAAAA | 976 | TTTTGTTGATTTAACTGTTG | 2745 |
| 1135 | 1157 | CCAGAACACTACGAGCCACAGCT | 977 | AGCTGTGGCTCGTAGTGTTC | 2746 |
| 1150 | 1172 | CCACAGCTTAAAACTCAAAGGAC | 978 | GTCCTTTGAGTTTTAAGCTG | 2747 |
| 1172 | 1194 | CCTGGCGGTGCTTCATATCCCTC | 979 | GAGGGATATGAAGCACCGCC | 2748 |
| 1190 | 1212 | CCCTCTAGAGGAGCCTGTTCTGT | 980 | ACAGAACAGGCTCCTCTAGA | 2749 |
| 1191 | 1213 | CCTCTAGAGGAGCCTGTTCTGTA | 981 | TACAGAACAGGCTCCTCTAG | 2750 |
| 1203 | 1225 | CCTGTTCTGTAATCGATAAACCC | 982 | GGGTTTATCGATTACAGAAC | 2751 |
| 1223 | 1245 | CCCCGATCAACCTCACCACCTCT | 983 | AGAGGTGGTGAGGTTGATCG | 2752 |
| 1224 | 1246 | CCCGATCAACCTCACCACCTCTT | 984 | AAGAGGTGGTGAGGTTGATC | 2753 |
| 1225 | 1247 | CCGATCAACCTCACCACCTCTTG | 985 | CAAGAGGTGGTGAGGTTGAT | 2754 |
| 1233 | 1255 | CCTCACCACCTCTTGCTCAGCCT | 986 | AGGCTGAGCAAGAGGTGGTG | 2755 |
| 1238 | 1260 | CCACCTCTTGCTCAGCCTATATA | 987 | TATATAGGCTGAGCAAGAGG | 2756 |
| 1241 | 1263 | CCTCTTGCTCAGCCTATATACCG | 988 | CGGTATATAGGCTGAGCAAG | 2757 |
| 1253 | 1275 | CCTATATACCGCCATCTTCAGCA | 989 | TGCTGAAGATGGCGGTATAT | 2758 |
| 1261 | 1283 | CCGCCATCTTCAGCAAACCCTGA | 990 | TCAGGGTTTGCTGAAGATGG | 2759 |
| 1264 | 1286 | CCATCTTCAGCAAACCCTGATGA | 991 | TCATCAGGGTTTGCTGAAGA | 2760 |
| 1278 | 1300 | CCCTGATGAAGGCTACAAAGTAA | 992 | TTACTTTGTAGCCTTCATCA | 2761 |
| 1279 | 1301 | CCTGATGAAGGCTACAAAGTAAG | 993 | CTTACTTTGTAGCCTTCATC | 2762 |
| 1310 | 1332 | CCCACGTAAAGACGTTAGGTCAA | 994 | TTGACCTAACGTCTTTACGT | 2763 |
| 1311 | 1333 | CCACGTAAAGACGTTAGGTCAAG | 995 | CTTGACCTAACGTCTTTACG | 2764 |
| 1340 | 1362 | CCCATGAGGTGGCAAGAAATGGG | 996 | CCCATTTCTTGCCACCTCAT | 2765 |
| 1341 | 1363 | CCATGAGGTGGCAAGAAATGGGC | 997 | GCCCATTTCTTGCCACCTCA | 2766 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 1375 | 1397 | CCCCAGAAAACTACGATAGCCCT | 998 | AGGGCTATCGTAGTTTTCTG | 2767 |
| 1376 | 1398 | CCCAGAAAACTACGATAGCCCTT | 999 | AAGGGCTATCGTAGTTTTCT | 2768 |
| 1377 | 1399 | CCAGAAAACTACGATAGCCCTTA | 1000 | TAAGGGCTATCGTAGTTTTC | 2769 |
| 1394 | 1416 | CCCTTATGAAACTTAAGGGTCGA | 1001 | TCGACCCTTAAGTTTCATAA | 2770 |
| 1395 | 1417 | CCTTATGAAACTTAAGGGTCGAA | 1002 | TTCGACCCTTAAGTTTCATA | 2771 |
| 1465 | 1487 | CCCTGAAGCGCGTACACACCGCC | 1003 | GGCGGTGTGTACGCGCTTCA | 2772 |
| 1466 | 1488 | CCTGAAGCGCGTACACACCGCCC | 1004 | GGGCGGTGTGTACGCGCTTC | 2773 |
| 1483 | 1505 | CCGCCCGTCACCCTCCTCAAGTA | 1005 | TACTTGAGGAGGGTGACGGG | 2774 |
| 1486 | 1508 | CCCGTCACCCTCCTCAAGTATAC | 1006 | GTATACTTGAGGAGGGTGAC | 2775 |
| 1487 | 1509 | CCGTCACCCTCCTCAAGTATACT | 1007 | AGTATACTTGAGGAGGGTGA | 2776 |
| 1493 | 1515 | CCCTCCTCAAGTATACTTCAAAG | 1008 | CTTTGAAGTATACTTGAGGA | 2777 |
| 1494 | 1516 | CCTCCTCAAGTATACTTCAAAGG | 1009 | CCTTTGAAGTATACTTGAGG | 2778 |
| 1497 | 1519 | CCTCAAGTATACTTCAAAGGACA | 1010 | TGTCCTTTGAAGTATACTTG | 2779 |
| 1531 | 1553 | CCCCTACGCATTTATATAGAGGA | 1011 | TCCTCTATATAAATGCGTAG | 2780 |
| 1532 | 1554 | CCCTACGCATTTATATAGAGGAG | 1012 | CTCCTCTATATAAATGCGTA | 2781 |
| 1533 | 1555 | CCTACGCATTTATATAGAGGAGA | 1013 | TCTCCTCTATATAAATGCGT | 2782 |
| 1601 | 1623 | CCAGAGTGTAGCTTAACACAAAG | 1014 | CTTTGTGTTAAGCTACACTC | 2783 |
| 1626 | 1648 | CCCAACTTACACTTAGGAGATTT | 1015 | AAATCTCCTAAGTGTAAGTT | 2784 |
| 1627 | 1649 | CCAACTTACACTTAGGAGATTTC | 1016 | GAAATCTCCTAAGTGTAAGT | 2785 |
| 1662 | 1684 | CCGCTCTGAGCTAAACCTAGCCC | 1017 | GGGCTAGGTTTAGCTCAGAG | 2786 |
| 1677 | 1699 | CCTAGCCCCAAACCCACTCCACC | 1018 | GGTGGAGTGGGTTTGGGGCT | 2787 |
| 1682 | 1704 | CCCCAAACCCACTCCACCTTACT | 1019 | AGTAAGGTGGAGTGGGTTTG | 2788 |
| 1683 | 1705 | CCCAAACCCACTCCACCTTACTA | 1020 | TAGTAAGGTGGAGTGGGTTT | 2789 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 1684 | 1706 | CCAAACCCACTCCACCTTACTAC | 1021 | GTAGTAAGGTGGAGTGGGTT | 2790 |
| 1689 | 1711 | CCCACTCCACCTTACTACCAGAC | 1022 | GTCTGGTAGTAAGGTGGAGT | 2791 |
| 1690 | 1712 | CCACTCCACCTTACTACCAGACA | 1023 | TGTCTGGTAGTAAGGTGGAG | 2792 |
| 1695 | 1717 | CCACCTTACTACCAGACAACCTT | 1024 | AAGGTTGTCTGGTAGTAAGG | 2793 |
| 1698 | 1720 | CCTTACTACCAGACAACCTTAGC | 1025 | GCTAAGGTTGTCTGGTAGTA | 2794 |
| 1706 | 1728 | CCAGACAACCTTAGCCAAACCAT | 1026 | ATGGTTTGGCTAAGGTTGTC | 2795 |
| 1714 | 1736 | CCTTAGCCAAACCATTTACCCAA | 1027 | TTGGGTAAATGGTTTGGCTA | 2796 |
| 1720 | 1742 | CCAAACCATTTACCCAAATAAAG | 1028 | CTTTATTTGGGTAAATGGTT | 2797 |
| 1725 | 1747 | CCATTTACCCAAATAAAGTATAG | 1029 | CTATACTTTATTTGGGTAAA | 2798 |
| 1732 | 1754 | CCCAAATAAAGTATAGGCGATAG | 1030 | CTATCGCCTATACTTTATTT | 2799 |
| 1733 | 1755 | CCAAATAAAGTATAGGCGATAGA | 1031 | TCTATCGCCTATACTTTATT | 2800 |
| 1764 | 1786 | CCTGGCGCAATAGATATAGTACC | 1032 | GGTACTATATCTATTGCGCC | 2801 |
| 1785 | 1807 | CCGCAAGGGAAAGATGAAAAATT | 1033 | AATTTTTCATCTTTCCCTTG | 2802 |
| 1812 | 1834 | CCAAGCATAATATAGCAAGGACT | 1034 | AGTCCTTGCTATATTATGCT | 2803 |
| 1837 | 1859 | CCCCTATACCTTCTGCATAATGA | 1035 | TCATTATGCAGAAGGTATAG | 2804 |
| 1838 | 1860 | CCCTATACCTTCTGCATAATGAA | 1036 | TTCATTATGCAGAAGGTATA | 2805 |
| 1839 | 1861 | CCTATACCTTCTGCATAATGAAT | 1037 | ATTCATTATGCAGAAGGTAT | 2806 |
| 1845 | 1867 | CCTTCTGCATAATGAATTAACTA | 1038 | TAGTTAATTCATTATGCAGA | 2807 |
| 1889 | 1911 | CCAAAGCTAAGACCCCCGAAACC | 1039 | GGTTTCGGGGGTCTTAGCTT | 2808 |
| 1901 | 1923 | CCCCCGAAACCAGACGAGCTACC | 1040 | GGTAGCTCGTCTGGTTTCGG | 2809 |
| 1902 | 1924 | CCCCGAAACCAGACGAGCTACCT | 1041 | AGGTAGCTCGTCTGGTTTCG | 2810 |
| 1903 | 1925 | CCCGAAACCAGACGAGCTACCTA | 1042 | TAGGTAGCTCGTCTGGTTTC | 2811 |
| 1904 | 1926 | CCGAAACCAGACGAGCTACCTAA | 1043 | TTAGGTAGCTCGTCTGGTTT | 2812 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 1910 | 1932 | CCAGACGAGCTACCTAAGAACAG | 1044 | CTGTTCTTAGGTAGCTCGTC | 2813 |
| 1922 | 1944 | CCTAAGAACAGCTAAAAGAGCAC | 1045 | GTGCTCTTTTAGCTGTTCTT | 2814 |
| 1946 | 1968 | CCCGTCTATGTAGCAAAATAGTG | 1046 | CACTATTTTGCTACATAGAC | 2815 |
| 1947 | 1969 | CCGTCTATGTAGCAAAATAGTGG | 1047 | CCACTATTTTGCTACATAGA | 2816 |
| 1996 | 2018 | CCTACCGAGCCTGGTGATAGCTG | 1048 | CAGCTATCACCAGGCTCGGT | 2817 |
| 2000 | 2022 | CCGAGCCTGGTGATAGCTGGTTG | 1049 | CAACCAGCTATCACCAGGCT | 2818 |
| 2005 | 2027 | CCTGGTGATAGCTGGTTGTCCAA | 1050 | TTGGACAACCAGCTATCACC | 2819 |
| 2024 | 2046 | CCAAGATAGAATCTTAGTTCAAC | 1051 | GTTGAACTAAGATTCTATCT | 2820 |
| 2057 | 2079 | CCCACAGAACCCTCTAAATCCCC | 1052 | GGGGATTTAGAGGGTTCTGT | 2821 |
| 2058 | 2080 | CCACAGAACCCTCTAAATCCCCT | 1053 | AGGGGATTTAGAGGGTTCTG | 2822 |
| 2066 | 2088 | CCCTCTAAATCCCCTTGTAAATT | 1054 | AATTTACAAGGGGATTTAGA | 2823 |
| 2067 | 2089 | CCTCTAAATCCCCTTGTAAATTT | 1055 | AAATTTACAAGGGGATTTAG | 2824 |
| 2076 | 2098 | CCCCTTGTAAATTTAACTGTTAG | 1056 | CTAACAGTTAAATTTACAAG | 2825 |
| 2077 | 2099 | CCCTTGTAAATTTAACTGTTAGT | 1057 | ACTAACAGTTAAATTTACAA | 2826 |
| 2078 | 2100 | CCTTGTAAATTTAACTGTTAGTC | 1058 | GACTAACAGTTAAATTTACA | 2827 |
| 2100 | 2122 | CCAAAGAGGAACAGCTCTTTGGA | 1059 | TCCAAAGAGCTGTTCCTCTT | 2828 |
| 2136 | 2158 | CCTTGTAGAGAGAGTAAAAAATT | 1060 | AATTTTTTACTCTCTCTACA | 2829 |
| 2164 | 2186 | CCCATAGTAGGCCTAAAAGCAGC | 1061 | GCTGCTTTTAGGCCTACTAT | 2830 |
| 2165 | 2187 | CCATAGTAGGCCTAAAAGCAGCC | 1062 | GGCTGCTTTTAGGCCTACTA | 2831 |
| 2175 | 2197 | CCTAAAAGCAGCCACCAATTAAG | 1063 | CTTAATTGGTGGCTGCTTTT | 2832 |
| 2186 | 2208 | CCACCAATTAAGAAAGCGTTCAA | 1064 | TTGAACGCTTTCTTAATTGG | 2833 |
| 2189 | 2211 | CCAATTAAGAAAGCGTTCAAGCT | 1065 | AGCTTGAACGCTTTCTTAAT | 2834 |
| 2217 | 2239 | CCCACTACCTAAAAAATCCCAAA | 1066 | TTTGGGATTTTTTAGGTAGT | 2835 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 2218 | 2240 | CCACTACCTAAAAAATCCCAAAC | 1067 | GTTTGGGATTTTTTAGGTAG | 2836 |
| 2224 | 2246 | CCTAAAAAATCCCAAACATATAA | 1068 | TTATATGTTTGGGATTTTTT | 2837 |
| 2234 | 2256 | CCCAAACATATAACTGAACTCCT | 1069 | AGGAGTTCAGTTATATGTTT | 2838 |
| 2235 | 2257 | CCAAACATATAACTGAACTCCTC | 1070 | GAGGAGTTCAGTTATATGTT | 2839 |
| 2254 | 2276 | CCTCACACCCAATTGGACCAATC | 1071 | GATTGGTCCAATTGGGTGTG | 2840 |
| 2261 | 2283 | CCCAATTGGACCAATCTATCACC | 1072 | GGTGATAGATTGGTCCAATT | 2841 |
| 2262 | 2284 | CCAATTGGACCAATCTATCACCC | 1073 | GGGTGATAGATTGGTCCAAT | 2842 |
| 2271 | 2293 | CCAATCTATCACCCTATAGAAGA | 1074 | TCTTCTATAGGGTGATAGAT | 2843 |
| 2282 | 2304 | CCCTATAGAAGAACTAATGTTAG | 1075 | CTAACATTAGTTCTTCTATA | 2844 |
| 2283 | 2305 | CCTATAGAAGAACTAATGTTAGT | 1076 | ACTAACATTAGTTCTTCTAT | 2845 |
| 2328 | 2350 | CCTCCGCATAAGCCTGCGTCAGA | 1077 | TCTGACGCAGGCTTATGCGG | 2846 |
| 2331 | 2353 | CCGCATAAGCCTGCGTCAGATTA | 1078 | TAATCTGACGCAGGCTTATG | 2847 |
| 2340 | 2362 | CCTGCGTCAGATTAAAACACTGA | 1079 | TCAGTGTTTTAATCTGACGC | 2848 |
| 2378 | 2400 | CCCAATATCTACAATCAACCAAC | 1080 | GTTGGTTGATTGTAGATATT | 2849 |
| 2379 | 2401 | CCAATATCTACAATCAACCAACA | 1081 | TGTTGGTTGATTGTAGATAT | 2850 |
| 2396 | 2418 | CCAACAAGTCATTATTACCCTCA | 1082 | TGAGGGTAATAATGACTTGT | 2851 |
| 2413 | 2435 | CCCTCACTGTCAACCCAACACAG | 1083 | CTGTGTTGGGTTGACAGTGA | 2852 |
| 2414 | 2436 | CCTCACTGTCAACCCAACACAGG | 1084 | CCTGTGTTGGGTTGACAGTG | 2853 |
| 2426 | 2448 | CCCAACACAGGCATGCTCATAAG | 1085 | CTTATGAGCATGCCTGTGTT | 2854 |
| 2427 | 2449 | CCAACACAGGCATGCTCATAAGG | 1086 | CCTTATGAGCATGCCTGTGT | 2855 |
| 2488 | 2510 | CCCCGCCTGTTTACCAAAAACAT | 1087 | ATGTTTTTGGTAAACAGGCG | 2856 |
| 2489 | 2511 | CCCGCCTGTTTACCAAAAACATC | 1088 | GATGTTTTTGGTAAACAGGC | 2857 |
| 2490 | 2512 | CCGCCTGTTTACCAAAAACATCA | 1089 | TGATGTTTTTGGTAAACAGG | 2858 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 2493 | 2515 | CCTGTTTACCAAAAACATCACCT | 1090 | AGGTGATGTTTTTGGTAAAC | 2859 |
| 2501 | 2523 | CCAAAAACATCACCTCTAGCATC | 1091 | GATGCTAGAGGTGATGTTTT | 2860 |
| 2513 | 2535 | CCTCTAGCATCACCAGTATTAGA | 1092 | TCTAATACTGGTGATGCTAG | 2861 |
| 2525 | 2547 | CCAGTATTAGAGGCACCGCCTGC | 1093 | GCAGGCGGTGCCTCTAATAC | 2862 |
| 2540 | 2562 | CCGCCTGCCCAGTGACACATGTT | 1094 | AACATGTGTCACTGGGCAGG | 2863 |
| 2543 | 2565 | CCTGCCCAGTGACACATGTTTAA | 1095 | TTAAACATGTGTCACTGGGC | 2864 |
| 2547 | 2569 | CCCAGTGACACATGTTTAACGGC | 1096 | GCCGTTAAACATGTGTCACT | 2865 |
| 2548 | 2570 | CCAGTGACACATGTTTAACGGCC | 1097 | GGCCGTTAAACATGTGTCAC | 2866 |
| 2569 | 2591 | CCGCGGTACCCTAACCGTGCAAA | 1098 | TTTGCACGGTTAGGGTACCG | 2867 |
| 2577 | 2599 | CCCTAACCGTGCAAAGGTAGCAT | 1099 | ATGCTACCTTTGCACGGTTA | 2868 |
| 2578 | 2600 | CCTAACCGTGCAAAGGTAGCATA | 1100 | TATGCTACCTTTGCACGGTT | 2869 |
| 2583 | 2605 | CCGTGCAAAGGTAGCATAATCAC | 1101 | GTGATTATGCTACCTTTGCA | 2870 |
| 2611 | 2633 | CCTTAAATAGGGACCTGTATGAA | 1102 | TTCATACAGGTCCCTATTTA | 2871 |
| 2624 | 2646 | CCTGTATGAATGGCTCCACGAGG | 1103 | CCTCGTGGAGCCATTCATAC | 2872 |
| 2639 | 2661 | CCACGAGGGTTCAGCTGTCTCTT | 1104 | AAGAGACAGCTGAACCCTCG | 2873 |
| 2670 | 2692 | CCAGTGAAATTGACCTGCCCGTG | 1105 | CACGGGCAGGTCAATTTCAC | 2874 |
| 2683 | 2705 | CCTGCCCGTGAAGAGGCGGGCAT | 1106 | ATGCCCGCCTCTTCACGGGC | 2875 |
| 2687 | 2709 | CCCGTGAAGAGGCGGGCATAACA | 1107 | TGTTATGCCCGCCTCTTCAC | 2876 |
| 2688 | 2710 | CCGTGAAGAGGCGGGCATAACAC | 1108 | GTGTTATGCCCGCCTCTTCA | 2877 |
| 2726 | 2748 | CCCTATGGAGCTTTAATTTATTA | 1109 | TAATAAATTAAAGCTCCATA | 2878 |
| 2727 | 2749 | CCTATGGAGCTTTAATTTATTAA | 1110 | TTAATAAATTAAAGCTCCAT | 2879 |
| 2761 | 2783 | CCTAACAAACCCACAGGTCCTAA | 1111 | TTAGGACCTGTGGGTTTGTT | 2880 |
| 2770 | 2792 | CCCACAGGTCCTAAACTACCAAA | 1112 | TTTGGTAGTTTAGGACCTGT | 2881 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 2771 | 2793 | CCACAGGTCCTAAACTACCAAAC | 1113 | GTTTGGTAGTTTAGGACCTG | 2882 |
| 2779 | 2801 | CCTAAACTACCAAACCTGCATTA | 1114 | TAATGCAGGTTTGGTAGTTT | 2883 |
| 2788 | 2810 | CCAAACCTGCATTAAAAATTTCG | 1115 | CGAAATTTTAATGCAGGTT | 2884 |
| 2793 | 2815 | CCTGCATTAAAAATTTCGGTTGG | 1116 | CCAACCGAAATTTTTAATGC | 2885 |
| 2821 | 2843 | CCTCGGAGCAGAACCCAACCTCC | 1117 | GGAGGTTGGGTTCTGCTCCG | 2886 |
| 2834 | 2856 | CCCAACCTCCGAGCAGTACATGC | 1118 | GCATGTACTGCTCGGAGGTT | 2887 |
| 2835 | 2857 | CCAACCTCCGAGCAGTACATGCT | 1119 | AGCATGTACTGCTCGGAGGT | 2888 |
| 2839 | 2861 | CCTCCGAGCAGTACATGCTAAGA | 1120 | TCTTAGCATGTACTGCTCGG | 2889 |
| 2842 | 2864 | CCGAGCAGTACATGCTAAGACTT | 1121 | AAGTCTTAGCATGTACTGCT | 2890 |
| 2867 | 2889 | CCAGTCAAAGCGAACTACTATAC | 1122 | GTATAGTAGTTCGCTTTGAC | 2891 |
| 2899 | 2921 | CCAATAACTTGACCAACGGAACA | 1123 | TGTTCCGTTGGTCAAGTTAT | 2892 |
| 2911 | 2933 | CCAACGGAACAAGTTACCCTAGG | 1124 | CCTAGGGTAACTTGTTCCGT | 2893 |
| 2927 | 2949 | CCCTAGGGATAACAGCGCAATCC | 1125 | GGATTGCGCTGTTATCCCTA | 2894 |
| 2928 | 2950 | CCTAGGGATAACAGCGCAATCCT | 1126 | AGGATTGCGCTGTTATCCCT | 2895 |
| 2948 | 2970 | CCTATTCTAGAGTCCATATCAAC | 1127 | GTTGATATGGACTCTAGAAT | 2896 |
| 2961 | 2983 | CCATATCAACAATAGGGTTTACG | 1128 | CGTAAACCCTATTGTTGATA | 2897 |
| 2985 | 3007 | CCTCGATGTTGGATCAGGACATC | 1129 | GATGTCCTGATCCAACATCG | 2898 |
| 3007 | 3029 | CCCGATGGTGCAGCCGCTATTAA | 1130 | TTAATAGCGGCTGCACCATC | 2899 |
| 3008 | 3030 | CCGATGGTGCAGCCGCTATTAAA | 1131 | TTTAATAGCGGCTGCACCAT | 2900 |
| 3020 | 3042 | CCGCTATTAAAGGTTCGTTTGTT | 1132 | AACAAACGAACCTTTAATAG | 2901 |
| 3056 | 3078 | CCTACGTGATCTGAGTTCAGACC | 1133 | GGTCTGAACTCAGATCACGT | 2902 |
| 3077 | 3099 | CCGGAGTAATCCAGGTCGGTTTC | 1134 | GAAACCGACCTGGATTACTC | 2903 |
| 3087 | 3109 | CCAGGTCGGTTTCTATCTACNTT | 1135 | AANGTAGATAGAAACCGACC | 2904 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 3116 | 3138 | CCTCCCTGTACGAAAGGACAAGA | 1136 | TCTTGTCCTTTCGTACAGGG | 2905 |
| 3119 | 3141 | CCCTGTACGAAAGGACAAGAGAA | 1137 | TTCTCTTGTCCTTTCGTACA | 2906 |
| 3120 | 3142 | CCTGTACGAAAGGACAAGAGAAA | 1138 | TTTCTCTTGTCCTTTCGTAC | 2907 |
| 3148 | 3170 | CCTACTTCACAAAGCGCCTTCCC | 1139 | GGGAAGGCGCTTTGTGAAGT | 2908 |
| 3164 | 3186 | CCTTCCCCGTAAATGATATCAT | 1140 | ATGATATCATTTACGGGGA | 2909 |
| 3168 | 3190 | CCCCCGTAAATGATATCATCTCA | 1141 | TGAGATGATATCATTTACGG | 2910 |
| 3169 | 3191 | CCCCGTAAATGATATCATCTCAA | 1142 | TTGAGATGATATCATTTACG | 2911 |
| 3170 | 3192 | CCCGTAAATGATATCATCTCAAC | 1143 | GTTGAGATGATATCATTTAC | 2912 |
| 3171 | 3193 | CCGTAAATGATATCATCTCAACT | 1144 | AGTTGAGATGATATCATTTA | 2913 |
| 3204 | 3226 | CCCACACCCACCCAAGAACAGGG | 1145 | CCCTGTTCTTGGGTGGGTGT | 2914 |
| 3205 | 3227 | CCACACCCACCCAAGAACAGGGT | 1146 | ACCCTGTTCTTGGGTGGGTG | 2915 |
| 3210 | 3232 | CCCACCCAAGAACAGGGTTTGTT | 1147 | AACAAACCCTGTTCTTGGGT | 2916 |
| 3211 | 3233 | CCACCCAAGAACAGGGTTTGTTA | 1148 | TAACAAACCCTGTTCTTGGG | 2917 |
| 3214 | 3236 | CCCAAGAACAGGGTTTGTTAAGA | 1149 | TCTTAACAAACCCTGTTCTT | 2918 |
| 3215 | 3237 | CCAAGAACAGGGTTTGTTAAGAT | 1150 | ATCTTAACAAACCCTGTTCT | 2919 |
| 3245 | 3267 | CCCGGTAATCGCATAAAACTTAA | 1151 | TTAAGTTTTATGCGATTACC | 2920 |
| 3246 | 3268 | CCGGTAATCGCATAAAACTTAAA | 1152 | TTAAGTTTTATGCGATTAC | 2921 |
| 3292 | 3314 | CCTCTTCTTAACAACATACCCAT | 1153 | ATGGGTATGTTGTTAAGAAG | 2922 |
| 3310 | 3332 | CCCATGGCCAACCTCCTACTCCT | 1154 | AGGAGTAGGAGGTTGGCCAT | 2923 |
| 3311 | 3333 | CCATGGCCAACCTCCTACTCCTC | 1155 | GAGGAGTAGGAGGTTGGCCA | 2924 |
| 3317 | 3339 | CCAACCTCCTACTCCTCATTGTA | 1156 | TACAATGAGGAGTAGGAGGT | 2925 |
| 3321 | 3343 | CCTCCTACTCCTCATTGTACCCA | 1157 | TGGGTACAATGAGGAGTAGG | 2926 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 3324 | 3346 | CCTACTCCTCATTGTACCCATTC | 1158 | GAATGGGTACAATGAGGAGT | 2927 |
| 3330 | 3352 | CCTCATTGTACCCATTCTAATCG | 1159 | CGATTAGAATGGGTACAATG | 2928 |
| 3340 | 3362 | CCCATTCTAATCGCAATGGCATT | 1160 | AATGCCATTGCGATTAGAAT | 2929 |
| 3341 | 3363 | CCATTCTAATCGCAATGCATTC | 1161 | GAATGCCATTGCGATTAGAA | 2930 |
| 3363 | 3385 | CCTAATGCTTACCGAACGAAAAA | 1162 | TTTTTCGTTCGGTAAGCATT | 2931 |
| 3374 | 3396 | CCGAACGAAAAATTCTAGGCTAT | 1163 | ATAGCCTAGAATTTTCGTT | 2932 |
| 3414 | 3436 | CCCCAACGTTGTAGGCCCCTACG | 1164 | CGTAGGGGCCTACAACGTTG | 2933 |
| 3415 | 3437 | CCCAACGTTGTAGGCCCCTACGG | 1165 | CCGTAGGGGCCTACAACGTT | 2934 |
| 3416 | 3438 | CCAACGTTGTAGGCCCCTACGGG | 1166 | CCCGTAGGGGCCTACAACGT | 2935 |
| 3429 | 3451 | CCCCTACGGGCTACTACAACCCT | 1167 | AGGGTTGTAGTAGCCCGTAG | 2936 |
| 3430 | 3452 | CCCTACGGGCTACTACAACCCTT | 1168 | AAGGGTTGTAGTAGCCCGTA | 2937 |
| 3431 | 3453 | CCTACGGGCTACTACAACCCTTC | 1169 | GAAGGGTTGTAGTAGCCCGT | 2938 |
| 3448 | 3470 | CCCTTCGCTGACGCCATAAAACT | 1170 | AGTTTTATGGCGTCAGCGAA | 2939 |
| 3449 | 3471 | CCTTCGCTGACGCCATAAAACTC | 1171 | GAGTTTTATGGCGTCAGCGA | 2940 |
| 3461 | 3483 | CCATAAAACTCTTCACCAAAGAG | 1172 | CTCTTTGGTGAAGAGTTTTA | 2941 |
| 3476 | 3498 | CCAAAGAGCCCCTAAAACCCGCC | 1173 | GGCGGGTTTTAGGGGCTCTT | 2942 |
| 3484 | 3506 | CCCCTAAAACCCGCCACATCTAC | 1174 | GTAGATGTGGCGGGTTTTAG | 2943 |
| 3485 | 3507 | CCCTAAAACCCGCCACATCTACC | 1175 | GGTAGATGTGGCGGGTTTTA | 2944 |
| 3486 | 3508 | CCTAAAACCCGCCACATCTACCA | 1176 | TGGTAGATGTGGCGGGTTTT | 2945 |
| 3493 | 3515 | CCCGCCACATCTACCATCACCCT | 1177 | AGGGTGATGGTAGATGTGGC | 2946 |
| 3494 | 3516 | CCGCCACATCTACCATCACCCTC | 1178 | GAGGGTGATGGTAGATGTGG | 2947 |
| 3497 | 3519 | CCACATCTACCATCACCCTCTAC | 1179 | GTAGAGGGTGATGGTAGATG | 2948 |
| 3506 | 3528 | CCATCACCCTCTACATCACCGCC | 1180 | GGCGGTGATGTAGAGGGTGA | 2949 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 3512 | 3534 | CCCTCTACATCACCGCCCCGACC | 1181 | GGTCGGGGCGGTGATGTAGA | 2950 |
| 3513 | 3535 | CCTCTACATCACCGCCCCGACCT | 1182 | AGGTCGGGGCGGTGATGTAG | 2951 |
| 3524 | 3546 | CCGCCCCGACCTTAGCTCTCACC | 1183 | GGTGAGAGCTAAGGTCGGGG | 2952 |
| 3527 | 3549 | CCCCGACCTTAGCTCTCACCATC | 1184 | GATGGTGAGAGCTAAGGTCG | 2953 |
| 3528 | 3550 | CCCGACCTTAGCTCTCACCATCG | 1185 | CGATGGTGAGAGCTAAGGTC | 2954 |
| 3529 | 3551 | CCGACCTTAGCTCTCACCATCGC | 1186 | GCGATGGTGAGAGCTAAGGT | 2955 |
| 3533 | 3555 | CCTTAGCTCTCACCATCGCTCTT | 1187 | AAGAGCGATGGTGAGAGCTA | 2956 |
| 3545 | 3567 | CCATCGCTCTTCTACTATGAACC | 1188 | GGTTCATAGTAGAAGAGCGA | 2957 |
| 3566 | 3588 | CCCCCCTCCCCATACCCAACCCC | 1189 | GGGGTTGGGTATGGGGAGGG | 2958 |
| 3567 | 3589 | CCCCCTCCCCATACCCAACCCCC | 1190 | GGGGGTTGGGTATGGGGAGG | 2959 |
| 3568 | 3590 | CCCCTCCCCATACCCAACCCCCT | 1191 | AGGGGGTTGGGTATGGGGAG | 2960 |
| 3569 | 3591 | CCCTCCCCATACCCAACCCCCTG | 1192 | CAGGGGGTTGGGTATGGGGA | 2961 |
| 3570 | 3592 | CCTCCCCATACCCAACCCCTGG | 1193 | CCAGGGGGTTGGGTATGGGG | 2962 |
| 3573 | 3595 | CCCCATACCCAACCCCCTGGTCA | 1194 | TGACCAGGGGGTTGGGTATG | 2963 |
| 3574 | 3596 | CCCATACCCAACCCCCTGGTCAA | 1195 | TTGACCAGGGGGTTGGGTAT | 2964 |
| 3575 | 3597 | CCATACCCAACCCCCTGGTCAAC | 1196 | GTTGACCAGGGGGTTGGGTA | 2965 |
| 3580 | 3602 | CCCAACCCCCTGGTCAACCTCAA | 1197 | TTGAGGTTGACCAGGGGGTT | 2966 |
| 3581 | 3603 | CCAACCCCCTGGTCAACCTCAAC | 1198 | GTTGAGGTTGACCAGGGGGT | 2967 |
| 3585 | 3607 | CCCCCTGGTCAACCTCAACCTAG | 1199 | CTAGGTTGAGGTTGACCAGG | 2968 |
| 3586 | 3608 | CCCCTGGTCAACCTCAACCTAGG | 1200 | CCTAGGTTGAGGTTGACCAG | 2969 |
| 3587 | 3609 | CCCTGGTCAACCTCAACCTAGGC | 1201 | GCCTAGGTTGAGGTTGACCA | 2970 |
| 3588 | 3610 | CCTGGTCAACCTCAACCTAGGCC | 1202 | GGCCTAGGTTGAGGTTGACC | 2971 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 3597 | 3619 | CCTCAACCTAGGCCTCCTATTTA | 1203 | TAAATAGGAGGCCTAGGTTG | 2972 |
| 3603 | 3625 | CCTAGGCCTCCTATTTATTCTAG | 1204 | CTAGAATAAATAGGAGGCCT | 2973 |
| 3609 | 3631 | CCTCCTATTTATTCTAGCCACCT | 1205 | AGGTGGCTAGAATAAATAGG | 2974 |
| 3612 | 3634 | CCTATTTATTCTAGCCACCTCTA | 1206 | TAGAGGTGGCTAGAATAAAT | 2975 |
| 3626 | 3648 | CCACCTCTAGCCTAGCCGTTTAC | 1207 | GTAAACGGCTAGGCTAGAGG | 2976 |
| 3629 | 3651 | CCTCTAGCCTAGCCGTTTACTCA | 1208 | TGAGTAAACGGCTAGGCTAG | 2977 |
| 3636 | 3658 | CCTAGCCGTTTACTCAATCCTCT | 1209 | AGAGGATTGAGTAAACGGCT | 2978 |
| 3641 | 3663 | CCGTTTACTCAATCCTCTGATCA | 1210 | TGATCAGAGGATTGAGTAAA | 2979 |
| 3654 | 3676 | CCTCTGATCAGGGTGAGCATCAA | 1211 | TTGATGCTCACCCTGATCAG | 2980 |
| 3689 | 3711 | CCCTGATCGGCGCACTGCGAGCA | 1212 | TGCTCGCAGTGCGCCGATCA | 2981 |
| 3690 | 3712 | CCTGATCGGCGCACTGCGAGCAG | 1213 | CTGCTCGCAGTGCGCCGATC | 2982 |
| 3716 | 3738 | CCCAAACAATCTCATATGAAGTC | 1214 | GACTTCATATGAGATTGTTT | 2983 |
| 3717 | 3739 | CCAAACAATCTCATATGAAGTCA | 1215 | TGACTTCATATGAGATTGTT | 2984 |
| 3740 | 3762 | CCCTAGCCATCATTCTACTATCA | 1216 | TGATAGTAGAATGATGGCTA | 2985 |
| 3741 | 3763 | CCTAGCCATCATTCTACTATCAA | 1217 | TTGATAGTAGAATGATGGCT | 2986 |
| 3746 | 3768 | CCATCATTCTACTATCAACATTA | 1218 | TAATGTTGATAGTAGAATGA | 2987 |
| 3782 | 3804 | CCTTTAACCTCTCCACCCTTATC | 1219 | GATAAGGGTGGAGAGGTTAA | 2988 |
| 3789 | 3811 | CCTCTCCACCCTTATCACAACAC | 1220 | GTGTTGTGATAAGGGTGGAG | 2989 |
| 3794 | 3816 | CCACCCTTATCACAACACAAGAA | 1221 | TTCTTGTGTTGTGATAAGGG | 2990 |
| 3797 | 3819 | CCCTTATCACAACACAAGAACAC | 1222 | GTGTTCTTGTGTTGTGATAA | 2991 |
| 3798 | 3820 | CCTTATCACAACACAAGAACACC | 1223 | GGTGTTCTTGTGTTGTGATA | 2992 |
| 3819 | 3841 | CCTCTGATTACTCCTGCCATCAT | 1224 | ATGATGGCAGGAGTAATCAG | 2993 |
| 3831 | 3853 | CCTGCCATCATGACCCTGGCCA | 1225 | TGGCCAGGGTCATGATGGC | 2994 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 3835 | 3857 | CCATCATGACCCTTGGCCATAAT | 1226 | ATTATGGCCAAGGGTCATGA | 2995 |
| 3844 | 3866 | CCCTTGGCCATAATATGATTTAT | 1227 | ATAAATCATATTATGGCCAA | 2996 |
| 3845 | 3867 | CCTTGGCCATAATATGATTTATC | 1228 | GATAAATCATATTATGGCCA | 2997 |
| 3851 | 3873 | CCATAATATGATTTATCTCCACA | 1229 | TGTGGAGATAAATCATATTA | 2998 |
| 3869 | 3891 | CCACACTAGCAGAGACCAACCGA | 1230 | TCGGTTGGTCTCTGCTAGTG | 2999 |
| 3884 | 3906 | CCAACCGAACCCCCTTCGACCTT | 1231 | AAGGTCGAAGGGGGTTCGGT | 3000 |
| 3888 | 3910 | CCGAACCCCCTTCGACCTTGCCG | 1232 | CGGCAAGGTCGAAGGGGGTT | 3001 |
| 3893 | 3915 | CCCCCTTCGACCTTGCCGAAGGG | 1233 | CCCTTCGGCAAGGTCGAAGG | 3002 |
| 3894 | 3916 | CCCCTTCGACCTTGCCGAAGGGG | 1234 | CCCCTTCGGCAAGGTCGAAG | 3003 |
| 3895 | 3917 | CCCTTCGACCTTGCCGAAGGGGA | 1235 | TCCCCTTCGGCAAGGTCGAA | 3004 |
| 3896 | 3918 | CCTTCGACCTTGCCGAAGGGGAG | 1236 | CTCCCCTTCGGCAAGGTCGA | 3005 |
| 3903 | 3925 | CCTTGCCGAAGGGGAGTCCGAAC | 1237 | GTTCGGACTCCCCTTCGGCA | 3006 |
| 3908 | 3930 | CCGAAGGGGAGTCCGAACTAGTC | 1238 | GACTAGTTCGGACTCCCCTT | 3007 |
| 3920 | 3942 | CCGAACTAGTCTCAGGCTTCAAC | 1239 | GTTGAAGCCTGAGACTAGTT | 3008 |
| 3953 | 3975 | CCGCAGGCCCCTTCGCCCTATTC | 1240 | GAATAGGGCGAAGGGCCTG | 3009 |
| 3960 | 3982 | CCCCTTCGCCCTATTCTTCATAG | 1241 | CTATGAAGAATAGGGCGAAG | 3010 |
| 3961 | 3983 | CCCTTCGCCCTATTCTTCATAGC | 1242 | GCTATGAAGAATAGGGCGAA | 3011 |
| 3962 | 3984 | CCTTCGCCCTATTCTTCATAGCC | 1243 | GGCTATGAAGAATAGGGCGA | 3012 |
| 3968 | 3990 | CCCTATTCTTCATAGCCGAATAC | 1244 | GTATTCGGCTATGAAGAATA | 3013 |
| 3969 | 3991 | CCTATTCTTCATAGCCGAATACA | 1245 | TGTATTCGGCTATGAAGAAT | 3014 |
| 3983 | 4005 | CCGAATACACAAACATTATTATA | 1246 | TATAATAATGTTTGTGTATT | 3015 |
| 4013 | 4035 | CCCTCACCACTACAATCTTCCTA | 1247 | TAGGAAGATTGTAGTGGTGA | 3016 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 4014 | 4036 | CCTCACCACTACAATCTTCCTAG | 1248 | CTAGGAAGATTGTAGTGGTG | 3017 |
| 4019 | 4041 | CCACTACAATCTTCCTAGGAACA | 1249 | TGTTCCTAGGAAGATTGTAG | 3018 |
| 4032 | 4054 | CCTAGGAACAACATATGACGCAC | 1250 | GTGCGTCATATGTTGTTCCT | 3019 |
| 4058 | 4080 | CCCCTGAACTCTACACAACATAT | 1251 | ATATGTTGTGTAGAGTTCAG | 3020 |
| 4059 | 4081 | CCCTGAACTCTACACAACATATT | 1252 | AATATGTTGTGTAGAGTTCA | 3021 |
| 4060 | 4082 | CCTGAACTCTACACAACATATTT | 1253 | AAATATGTTGTGTAGAGTTC | 3022 |
| 4088 | 4110 | CCAAGACCCTACTTCTAACCTCC | 1254 | GGAGGTTAGAAGTAGGGTCT | 3023 |
| 4094 | 4116 | CCCTACTTCTAACCTCCCTGTTC | 1255 | GAACAGGGAGGTTAGAAGTA | 3024 |
| 4095 | 4117 | CCTACTTCTAACCTCCCTGTTCT | 1256 | AGAACAGGGAGGTTAGAAGT | 3025 |
| 4106 | 4128 | CCTCCCTGTTCTTATGAATTCGA | 1257 | TCGAATTCATAAGAACAGGG | 3026 |
| 4109 | 4131 | CCCTGTTCTTATGAATTCGAACA | 1258 | TGTTCGAATTCATAAGAACA | 3027 |
| 4110 | 4132 | CCTGTTCTTATGAATTCGAACAG | 1259 | CTGTTCGAATTCATAAGAAC | 3028 |
| 4137 | 4159 | CCCCCGATTCCGCTACGACCAAC | 1260 | GTTGGTCGTAGCGGAATCGG | 3029 |
| 4138 | 4160 | CCCCGATTCCGCTACGACCAACT | 1261 | AGTTGGTCGTAGCGGAATCG | 3030 |
| 4139 | 4161 | CCCGATTCCGCTACGACCAACTC | 1262 | GAGTTGGTCGTAGCGGAATC | 3031 |
| 4140 | 4162 | CCGATTCCGCTACGACCAACTCA | 1263 | TGAGTTGGTCGTAGCGGAAT | 3032 |
| 4146 | 4168 | CCGCTACGACCAACTCATACACC | 1264 | GGTGTATGAGTTGGTCGTAG | 3033 |
| 4155 | 4177 | CCAACTCATACACCTCCTATGAA | 1265 | TTCATAGGAGGTGTATGAGT | 3034 |
| 4167 | 4189 | CCTCCTATGAAAAAACTTCCTAC | 1266 | GTAGGAAGTTTTTTCATAGG | 3035 |
| 4170 | 4192 | CCTATGAAAAAACTTCCTACCAC | 1267 | GTGGTAGGAAGTTTTTTCAT | 3036 |
| 4185 | 4207 | CCTACCACTCACCCTAGCATTAC | 1268 | GTAATGCTAGGGTGAGTGGT | 3037 |
| 4189 | 4211 | CCACTCACCCTAGCATTACTTAT | 1269 | ATAAGTAATGCTAGGGTGAG | 3038 |
| 4196 | 4218 | CCCTAGCATTACTTATATGATAT | 1270 | ATATCATATAAGTAATGCTA | 3039 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 4197 | 4219 | CCTAGCATTACTTATATGATATG | 1271 | CATATCATATAAGTAATGCT | 3040 |
| 4223 | 4245 | CCATACCCATTACAATCTCCAGC | 1272 | GCTGGAGATTGTAATGGGTA | 3041 |
| 4228 | 4250 | CCCATTACAATCTCCAGCATTCC | 1273 | GGAATGCTGGAGATTGTAAT | 3042 |
| 4229 | 4251 | CCATTACAATCTCCAGCATTCCC | 1274 | GGGAATGCTGGAGATTGTAA | 3043 |
| 4241 | 4263 | CCAGCATTCCCCCTCAAACCTAA | 1275 | TTAGGTTTGAGGGGGAATGC | 3044 |
| 4249 | 4271 | CCCCCTCAAACCTAAGAAATATG | 1276 | CATATTTCTTAGGTTTGAGG | 3045 |
| 4250 | 4272 | CCCCTCAAACCTAAGAAATATGT | 1277 | ACATATTTCTTAGGTTTGAG | 3046 |
| 4251 | 4273 | CCCTCAAACCTAAGAAATATGTC | 1278 | GACATATTTCTTAGGTTTGA | 3047 |
| 4252 | 4274 | CCTCAAACCTAAGAAATATGTCT | 1279 | AGACATATTTCTTAGGTTTG | 3048 |
| 4259 | 4281 | CCTAAGAAATATGTCTGATAAAA | 1280 | TTTTATCAGACATATTTCTT | 3049 |
| 4318 | 4340 | CCCCCTTATTTCTAGGACTATGA | 1281 | TCATAGTCCTAGAAATAAGG | 3050 |
| 4319 | 4341 | CCCCTTATTTCTAGGACTATGAG | 1282 | CTCATAGTCCTAGAAATAAG | 3051 |
| 4320 | 4342 | CCCTTATTTCTAGGACTATGAGA | 1283 | TCTCATAGTCCTAGAAATAA | 3052 |
| 4321 | 4343 | CCTTATTTCTAGGACTATGAGAA | 1284 | TTCTCATAGTCCTAGAAATA | 3053 |
| 4349 | 4371 | CCCATCCCTGAGAATCCAAAATT | 1285 | AATTTTGGATTCTCAGGGAT | 3054 |
| 4350 | 4372 | CCATCCCTGAGAATCCAAAATTC | 1286 | GAATTTTGGATTCTCAGGGA | 3055 |
| 4354 | 4376 | CCCTGAGAATCCAAAATTCTCCG | 1287 | CGGAGAATTTTGGATTCTCA | 3056 |
| 4355 | 4377 | CCTGAGAATCCAAAATTCTCCGT | 1288 | ACGGAGAATTTTGGATTCTC | 3057 |
| 4364 | 4386 | CCAAAATTCTCCGTGCCACCTAT | 1289 | ATAGGTGGCACGGAGAATTT | 3058 |
| 4374 | 4396 | CCGTGCCACCTATCACACCCCAT | 1290 | ATGGGGTGTGATAGGTGGCA | 3059 |
| 4379 | 4401 | CCACCTATCACACCCCATCCTAA | 1291 | TTAGGATGGGGTGTGATAGG | 3060 |
| 4382 | 4404 | CCTATCACACCCCATCCTAAAGT | 1292 | ACTTTAGGATGGGGTGTGAT | 3061 |
| 4391 | 4413 | CCCCATCCTAAAGTAAGGTCAGC | 1293 | GCTGACCTTACTTTAGGATG | 3062 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 4392 | 4414 | CCCATCCTAAAGTAAGGTCAGCT | 1294 | AGCTGACCTTACTTTAGGAT | 3063 |
| 4393 | 4415 | CCATCCTAAAGTAAGGTCAGCTA | 1295 | TAGCTGACCTTACTTTAGGA | 3064 |
| 4397 | 4419 | CCTAAAGTAAGGTCAGCTAAATA | 1296 | TATTTAGCTGACCTTACTTT | 3065 |
| 4430 | 4452 | CCCATACCCCGAAAATGTTGGTT | 1297 | AACCAACATTTTCGGGGTAT | 3066 |
| 4431 | 4453 | CCATACCCCGAAAATGTTGGTTA | 1298 | TAACCAACATTTTCGGGGTA | 3067 |
| 4436 | 4458 | CCCCGAAAATGTTGGTTATACCC | 1299 | GGGTATAACCAACATTTTCG | 3068 |
| 4437 | 4459 | CCCGAAAATGTTGGTTATACCCT | 1300 | AGGGTATAACCAACATTTTC | 3069 |
| 4438 | 4460 | CCGAAAATGTTGGTTATACCCTT | 1301 | AAGGGTATAACCAACATTTT | 3070 |
| 4456 | 4478 | CCCTTCCCGTACTAATTAATCCC | 1302 | GGGATTAATTAGTACGGGAA | 3071 |
| 4457 | 4479 | CCTTCCCGTACTAATTAATCCCC | 1303 | GGGGATTAATTAGTACGGGA | 3072 |
| 4461 | 4483 | CCCGTACTAATTAATCCCCTGGC | 1304 | GCCAGGGGATTAATTAGTAC | 3073 |
| 4462 | 4484 | CCGTACTAATTAATCCCCTGGCC | 1305 | GGCCAGGGGATTAATTAGTA | 3074 |
| 4476 | 4498 | CCCCTGGCCCAACCCGTCATCTA | 1306 | TAGATGACGGGTTGGGCCAG | 3075 |
| 4477 | 4499 | CCCTGGCCCAACCCGTCATCTAC | 1307 | GTAGATGACGGGTTGGGCCA | 3076 |
| 4478 | 4500 | CCTGGCCCAACCCGTCATCTACT | 1308 | AGTAGATGACGGGTTGGGCC | 3077 |
| 4483 | 4505 | CCCAACCCGTCATCTACTCTACC | 1309 | GGTAGAGTAGATGACGGGTT | 3078 |
| 4484 | 4506 | CCAACCCGTCATCTACTCTACCA | 1310 | TGGTAGAGTAGATGACGGGT | 3079 |
| 4488 | 4510 | CCCGTCATCTACTCTACCATCTT | 1311 | AAGATGGTAGAGTAGATGAC | 3080 |
| 4489 | 4511 | CCGTCATCTACTCTACCATCTTT | 1312 | AAAGATGGTAGAGTAGATGA | 3081 |
| 4504 | 4526 | CCATCTTTGCAGGCACACTCATC | 1313 | GATGAGTGTGCCTGCAAAGA | 3082 |
| 4555 | 4577 | CCTGAGTAGGCCTAGAAATAAAC | 1314 | GTTTATTTCTAGGCCTACTC | 3083 |
| 4565 | 4587 | CCTAGAAATAAACATGCTAGCTT | 1315 | AAGCTAGCATGTTTATTTCT | 3084 |
| 4593 | 4615 | CCAGTTCTAACCAAAAAATAAA | 1316 | TTTATTTTTTGGTTAGAAC | 3085 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 4603 | 4625 | CCAAAAAATAAACCCTCGTTCC | 1317 | GGAACGAGGGTTTATTTTTT | 3086 |
| 4616 | 4638 | CCCTCGTTCCACAGAAGCTGCCA | 1318 | TGGCAGCTTCTGTGGAACGA | 3087 |
| 4617 | 4639 | CCTCGTTCCACAGAAGCTGCCAT | 1319 | ATGGCAGCTTCTGTGGAACG | 3088 |
| 4624 | 4646 | CCACAGAAGCTGCCATCAAGTAT | 1320 | ATACTTGATGGCAGCTTCTG | 3089 |
| 4636 | 4658 | CCATCAAGTATTTCCTCACGCAA | 1321 | TTGCGTGAGGAAATACTTGA | 3090 |
| 4649 | 4671 | CCTCACGCAAGCAACCGCATCCA | 1322 | TGGATGCGGTTGCTTGCGTG | 3091 |
| 4663 | 4685 | CCGCATCCATAATCCTTCTAATA | 1323 | TATTAGAAGGATTATGGATG | 3092 |
| 4669 | 4691 | CCATAATCCTTCTAATAGCTATC | 1324 | GATAGCTATTAGAAGGATTA | 3093 |
| 4676 | 4698 | CCTTCTAATAGCTATCCTCTTCA | 1325 | TGAAGAGGATAGCTATTAGA | 3094 |
| 4691 | 4713 | CCTCTTCAACAATATACTCTCCG | 1326 | CGGAGAGTATATTGTTGAAG | 3095 |
| 4711 | 4733 | CCGGACAATGAACCATAACCAAT | 1327 | ATTGGTTATGGTTCATTGTC | 3096 |
| 4723 | 4745 | CCATAACCAATACTACCAATCAA | 1328 | TTGATTGGTAGTATTGGTTA | 3097 |
| 4729 | 4751 | CCAATACTACCAATCAATACTCA | 1329 | TGAGTATTGATTGGTAGTAT | 3098 |
| 4738 | 4760 | CCAATCAATACTCATCATTAATA | 1330 | TATTAATGATGAGTATTGAT | 3099 |
| 4795 | 4817 | CCCCCTTTCACTTCTGAGTCCCA | 1331 | TGGGACTCAGAAGTGAAAGG | 3100 |
| 4796 | 4818 | CCCCTTTCACTTCTGAGTCCCAG | 1332 | CTGGGACTCAGAAGTGAAAG | 3101 |
| 4797 | 4819 | CCCTTTCACTTCTGAGTCCCAGA | 1333 | TCTGGGACTCAGAAGTGAAA | 3102 |
| 4798 | 4820 | CCTTTCACTTCTGAGTCCCAGAG | 1334 | CTCTGGGACTCAGAAGTGAA | 3103 |
| 4814 | 4836 | CCCAGAGGTTACCCAAGGCACCC | 1335 | GGGTGCCTTGGGTAACCTCT | 3104 |
| 4815 | 4837 | CCAGAGGTTACCCAAGGCACCCC | 1336 | GGGGTGCCTTGGGTAACCTC | 3105 |
| 4825 | 4847 | CCCAAGGCACCCCTCTGACATCC | 1337 | GGATGTCAGAGGGGTGCCTT | 3106 |
| 4826 | 4848 | CCAAGGCACCCCTCTGACATCCG | 1338 | CGGATGTCAGAGGGGTGCCT | 3107 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 4834 | 4856 | CCCCTCTGACATCCGGCCTGCTT | 1339 | AAGCAGGCCGGATGTCAGAG | 3108 |
| 4835 | 4857 | CCCTCTGACATCCGGCCTGCTTC | 1340 | GAAGCAGGCCGGATGTCAGA | 3109 |
| 4836 | 4858 | CCTCTGACATCCGGCCTGCTTCT | 1341 | AGAAGCAGGCCGGATGTCAG | 3110 |
| 4846 | 4868 | CCGGCCTGCTTCTTCTCACATGA | 1342 | TCATGTGAGAAGAAGCAGGC | 3111 |
| 4850 | 4872 | CCTGCTTCTTCTCACATGACAAA | 1343 | TTTGTCATGTGAGAAGAAGC | 3112 |
| 4879 | 4901 | CCCCCATCTCAATCATATACCAA | 1344 | TTGGTATATGATTGAGATGG | 3113 |
| 4880 | 4902 | CCCCATCTCAATCATATACCAAA | 1345 | TTTGGTATATGATTGAGATG | 3114 |
| 4881 | 4903 | CCCATCTCAATCATATACCAAAT | 1346 | ATTTGGTATATGATTGAGAT | 3115 |
| 4882 | 4904 | CCATCTCAATCATATACCAAATC | 1347 | GATTTGGTATATGATTGAGA | 3116 |
| 4898 | 4920 | CCAAATCTCTCCCTCACTAAACG | 1348 | CGTTTAGTGAGGGAGAGATT | 3117 |
| 4908 | 4930 | CCCTCACTAAACGTAAGCCTTCT | 1349 | AGAAGGCTTACGTTTAGTGA | 3118 |
| 4909 | 4931 | CCTCACTAAACGTAAGCCTTCTC | 1350 | GAGAAGGCTTACGTTTAGTG | 3119 |
| 4925 | 4947 | CCTTCTCCTCACTCTCTCAATCT | 1351 | AGATTGAGAGAGTGAGGAGA | 3120 |
| 4931 | 4953 | CCTCACTCTCTCAATCTTATCCA | 1352 | TGGATAAGATTGAGAGAGTG | 3121 |
| 4951 | 4973 | CCATCATAGCAGGCAGTTGAGGT | 1353 | ACCTCAACTGCCTGCTATGA | 3122 |
| 4982 | 5004 | CCAAACCCAGCTACGCAAAATCT | 1354 | AGATTTTGCGTAGCTGGGTT | 3123 |
| 4987 | 5009 | CCCAGCTACGCAAAATCTTAGCA | 1355 | TGCTAAGATTTTGCGTAGCT | 3124 |
| 4988 | 5010 | CCAGCTACGCAAAATCTTAGCAT | 1356 | ATGCTAAGATTTTGCGTAGC | 3125 |
| 5014 | 5036 | CCTCAATTACCCACATAGGATGA | 1357 | TCATCCTATGTGGGTAATTG | 3126 |
| 5023 | 5045 | CCCACATAGGATGAATAATAGCA | 1358 | TGCTATTATTCATCCTATGT | 3127 |
| 5024 | 5046 | CCACATAGGATGAATAATAGCAG | 1359 | CTGCTATTATTCATCCTATG | 3128 |
| 5052 | 5074 | CCGTACAACCCTAACATAACCAT | 1360 | ATGGTTATGTTAGGGTTGTA | 3129 |
| 5060 | 5082 | CCCTAACATAACCATTCTTAATT | 1361 | AATTAAGAATGGTTATGTTA | 3130 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 5061 | 5083 | CCTAACATAACCATTCTTAATTT | 1362 | AAATTAAGAATGGTTATGTT | 3131 |
| 5071 | 5093 | CCATTCTTAATTTAACTATTTAT | 1363 | ATAAATAGTTAAATTAAGAA | 3132 |
| 5099 | 5121 | CCTAACTACTACCGCATTCCTAC | 1364 | GTAGGAATGCGGTAGTAGTT | 3133 |
| 5110 | 5132 | CCGCATTCCTACTACTCAACTTA | 1365 | TAAGTTGAGTAGTAGGAATG | 3134 |
| 5117 | 5139 | CCTACTACTCAACTTAAACTCCA | 1366 | TGGAGTTTAAGTTGAGTAGT | 3135 |
| 5137 | 5159 | CCAGCACCACGACCCTACTACTA | 1367 | TAGTAGTAGGGTCGTGGTGC | 3136 |
| 5143 | 5165 | CCACGACCCTACTACTATCTCGC | 1368 | GCGAGATAGTAGTAGGGTCG | 3137 |
| 5149 | 5171 | CCCTACTACTATCTCGCACCTGA | 1369 | TCAGGTGCGAGATAGTAGTA | 3138 |
| 5150 | 5172 | CCTACTACTATCTCGCACCTGAA | 1370 | TTCAGGTGCGAGATAGTAGT | 3139 |
| 5167 | 5189 | CCTGAAACAAGCTAACATGACTA | 1371 | TAGTCATGTTAGCTTGTTTC | 3140 |
| 5193 | 5215 | CCCTTAATTCCATCCACCCTCCT | 1372 | AGGAGGGTGGATGGAATTAA | 3141 |
| 5194 | 5216 | CCTTAATTCCATCCACCCTCCTC | 1373 | GAGGAGGGTGGATGGAATTA | 3142 |
| 5202 | 5224 | CCATCCACCCTCCTCTCCCTAGG | 1374 | CCTAGGGAGAGGAGGGTGGA | 3143 |
| 5206 | 5228 | CCACCCTCCTCTCCCTAGGAGGC | 1375 | GCCTCCTAGGGAGAGGAGGG | 3144 |
| 5209 | 5231 | CCCTCCTCTCCCTAGGAGGCCTG | 1376 | CAGGCCTCCTAGGGAGAGGA | 3145 |
| 5210 | 5232 | CCTCCTCTCCCTAGGAGGCCTGC | 1377 | GCAGGCCTCCTAGGGAGAGG | 3146 |
| 5213 | 5235 | CCTCTCCCTAGGAGGCCTGCCCC | 1378 | GGGGCAGGCCTCCTAGGGAG | 3147 |
| 5218 | 5240 | CCCTAGGAGGCCTGCCCCGCTA | 1379 | TAGCGGGGCAGGCCTCCTA | 3148 |
| 5219 | 5241 | CCTAGGAGGCCTGCCCCGCTAA | 1380 | TTAGCGGGGCAGGCCTCCT | 3149 |
| 5228 | 5250 | CCTGCCCCCGCTAACCGGCTTTT | 1381 | AAAAGCCGGTTAGCGGGGC | 3150 |
| 5232 | 5254 | CCCCCGCTAACCGGCTTTTTGCC | 1382 | GGCAAAAAGCCGGTTAGCGG | 3151 |
| 5233 | 5255 | CCCCGCTAACCGGCTTTTTGCCC | 1383 | GGGCAAAAAGCCGGTTAGCG | 3152 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 5234 | 5256 | CCCGCTAACCGGCTTTTTGCCCA | 1384 | TGGGCAAAAGCCGGTTAGC | 3153 |
| 5235 | 5257 | CCGCTAACCGGCTTTTTGCCCAA | 1385 | TTGGGCAAAAGCCGGTTAG | 3154 |
| 5242 | 5264 | CCGGCTTTTTGCCCAAATGGGCC | 1386 | GGCCCATTTGGGCAAAAAGC | 3155 |
| 5253 | 5275 | CCCAAATGGGCCATTATCGAAGA | 1387 | TCTTCGATAATGGCCCATTT | 3156 |
| 5254 | 5276 | CCAAATGGGCCATTATCGAAGAA | 1388 | TTCTTCGATAATGGCCCATT | 3157 |
| 5263 | 5285 | CCATTATCGAAGAATTCACAAAA | 1389 | TTTTGTGAATTCTTCGATAA | 3158 |
| 5294 | 5316 | CCTCATCATCCCCACCATCATAG | 1390 | CTATGATGGTGGGGATGATG | 3159 |
| 5303 | 5325 | CCCCACCATCATAGCCACCATCA | 1391 | TGATGGTGGCTATGATGGTG | 3160 |
| 5304 | 5326 | CCCACCATCATAGCCACCATCAC | 1392 | GTGATGGTGGCTATGATGGT | 3161 |
| 5305 | 5327 | CCACCATCATAGCCACCATCACC | 1393 | GGTGATGGTGGCTATGATGG | 3162 |
| 5308 | 5330 | CCATCATAGCCACCATCACCCTC | 1394 | GAGGGTGATGGTGGCTATGA | 3163 |
| 5317 | 5339 | CCACCATCACCCTCCTTAACCTC | 1395 | GAGGTTAAGGAGGGTGATGG | 3164 |
| 5320 | 5342 | CCATCACCCTCCTTAACCTCTAC | 1396 | GTAGAGGTTAAGGAGGGTGA | 3165 |
| 5326 | 5348 | CCCTCCTTAACCTCTACTTCTAC | 1397 | GTAGAAGTAGAGGTTAAGGA | 3166 |
| 5327 | 5349 | CCTCCTTAACCTCTACTTCTACC | 1398 | GGTAGAAGTAGAGGTTAAGG | 3167 |
| 5330 | 5352 | CCTTAACCTCTACTTCTACCTAC | 1399 | GTAGGTAGAAGTAGAGGTTA | 3168 |
| 5336 | 5358 | CCTCTACTTCTACCTACGCCTAA | 1400 | TTAGGCGTAGGTAGAAGTAG | 3169 |
| 5348 | 5370 | CCTACGCCTAATCTACTCCACCT | 1401 | AGGTGGAGTAGATTAGGCGT | 3170 |
| 5354 | 5376 | CCTAATCTACTCCACCTCAATCA | 1402 | TGATTGAGGTGGAGTAGATT | 3171 |
| 5365 | 5387 | CCACCTCAATCACACTACTCCCC | 1403 | GGGGAGTAGTGTGATTGAGG | 3172 |
| 5368 | 5390 | CCTCAATCACACTACTCCCCATA | 1404 | TATGGGGAGTAGTGTGATTG | 3173 |
| 5384 | 5406 | CCCCATATCTAACAACGTAAAAA | 1405 | TTTTTACGTTGTTAGATATG | 3174 |
| 5385 | 5407 | CCCATATCTAACAACGTAAAAAT | 1406 | ATTTTTACGTTGTTAGATAT | 3175 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 5386 | 5408 | CCATATCTAACAACGTAAAAATA | 1407 | TATTTTTACGTTGTTAGATA | 3176 |
| 5433 | 5455 | CCCACCCCATTCCTCCCCACACT | 1408 | AGTGTGGGGAGGAATGGGGT | 3177 |
| 5434 | 5456 | CCACCCCATTCCTCCCCACACTC | 1409 | GAGTGTGGGGAGGAATGGGG | 3178 |
| 5437 | 5459 | CCCCATTCCTCCCCACACTCATC | 1410 | GATGAGTGTGGGGAGGAATG | 3179 |
| 5438 | 5460 | CCCATTCCTCCCCACACTCATCG | 1411 | CGATGAGTGTGGGGAGGAAT | 3180 |
| 5439 | 5461 | CCATTCCTCCCCACACTCATCGC | 1412 | GCGATGAGTGTGGGGAGGAA | 3181 |
| 5444 | 5466 | CCTCCCCACACTCATCGCCCTTA | 1413 | TAAGGGCGATGAGTGTGGGG | 3182 |
| 5447 | 5469 | CCCCACACTCATCGCCCTTACCA | 1414 | TGGTAAGGGCGATGAGTGTG | 3183 |
| 5448 | 5470 | CCCACACTCATCGCCCTTACCAC | 1415 | GTGGTAAGGGCGATGAGTGT | 3184 |
| 5449 | 5471 | CCACACTCATCGCCCTTACCACG | 1416 | CGTGGTAAGGGCGATGAGTG | 3185 |
| 5461 | 5483 | CCCTTACCACGCTACTCCTACCT | 1417 | AGGTAGGAGTAGCGTGGTAA | 3186 |
| 5462 | 5484 | CCTTACCACGCTACTCCTACCTA | 1418 | TAGGTAGGAGTAGCGTGGTA | 3187 |
| 5467 | 5489 | CCACGCTACTCCTACCTATCTCC | 1419 | GGAGATAGGTAGGAGTAGCG | 3188 |
| 5477 | 5499 | CCTACCTATCTCCCCTTTATAC | 1420 | GTATAAAGGGGAGATAGGT | 3189 |
| 5481 | 5503 | CCTATCTCCCCTTTTATACTAAT | 1421 | ATTAGTATAAAAGGGGAGAT | 3190 |
| 5488 | 5510 | CCCCTTTTATACTAATAATCTTA | 1422 | TAAGATTATTAGTATAAAAG | 3191 |
| 5489 | 5511 | CCCTTTTATACTAATAATCTTAT | 1423 | ATAAGATTATTAGTATAAAA | 3192 |
| 5490 | 5512 | CCTTTTATACTAATAATCTTATA | 1424 | TATAAGATTATTAGTATAAA | 3193 |
| 5534 | 5556 | CCAAGAGCCTTCAAAGCCCTCAG | 1425 | CTGAGGGCTTTGAAGGCTCT | 3194 |
| 5541 | 5563 | CCTTCAAAGCCCTCAGTAAGTTG | 1426 | CAACTTACTGAGGGCTTTGA | 3195 |
| 5550 | 5572 | CCCTCAGTAAGTTGCAATACTTA | 1427 | TAAGTATTGCAACTTACTGA | 3196 |
| 5551 | 5573 | CCTCAGTAAGTTGCAATACTTAA | 1428 | TTAAGTATTGCAACTTACTG | 3197 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 5601 | 5623 | CCCCACTCTGCATCAACTGAACG | 1429 | CGTTCAGTTGATGCAGAGTG | 3198 |
| 5602 | 5624 | CCCACTCTGCATCAACTGAACGC | 1430 | GCGTTCAGTTGATGCAGAGT | 3199 |
| 5603 | 5625 | CCACTCTGCATCAACTGAACGCA | 1431 | TGCGTTCAGTTGATGCAGAG | 3200 |
| 5632 | 5654 | CCACTTTAATTAAGCTAAGCCCT | 1432 | AGGGCTTAGCTTAATTAAAG | 3201 |
| 5651 | 5673 | CCCTTACTAGACCAATGGGACTT | 1433 | AAGTCCCATTGGTCTAGTAA | 3202 |
| 5652 | 5674 | CCTTACTAGACCAATGGGACTTA | 1434 | TAAGTCCCATTGGTCTAGTA | 3203 |
| 5662 | 5684 | CCAATGGGACTTAAACCCACAAA | 1435 | TTTGTGGGTTTAAGTCCCAT | 3204 |
| 5677 | 5699 | CCCACAAACACTTAGTTAACAGC | 1436 | GCTGTTAACTAAGTGTTTGT | 3205 |
| 5678 | 5700 | CCACAAACACTTAGTTAACAGCT | 1437 | AGCTGTTAACTAAGTGTTTG | 3206 |
| 5706 | 5728 | CCCTAATCAACTGGCTTCAATCT | 1438 | AGATTGAAGCCAGTTGATTA | 3207 |
| 5707 | 5729 | CCTAATCAACTGGCTTCAATCTA | 1439 | TAGATTGAAGCCAGTTGATT | 3208 |
| 5735 | 5757 | CCCGCCGCGGGAAAAAAGGCGG | 1440 | CCGCCTTTTTTCCCGGCGGC | 3209 |
| 5736 | 5758 | CCGCCGCGGGAAAAAAGGCGGG | 1441 | CCCGCCTTTTTTCCCGGCGG | 3210 |
| 5739 | 5761 | CCGCCGGGAAAAAAGGCGGGAGA | 1442 | TCTCCCGCCTTTTTTCCCGG | 3211 |
| 5742 | 5764 | CCGGGAAAAAAGGCGGGAGAAGC | 1443 | GCTTCTCCCGCCTTTTTTCC | 3212 |
| 5764 | 5786 | CCCCGGCAGGTTTGAAGCTGCTT | 1444 | AAGCAGCTTCAAACCTGCCG | 3213 |
| 5765 | 5787 | CCCGGCAGGTTTGAAGCTGCTTC | 1445 | GAAGCAGCTTCAAACCTGCC | 3214 |
| 5766 | 5788 | CCGGCAGGTTTGAAGCTGCTTCT | 1446 | AGAAGCAGCTTCAAACCTGC | 3215 |
| 5817 | 5839 | CCTCGGAGCTGGTAAAAAGAGGC | 1447 | GCCTCTTTTTACCAGCTCCG | 3216 |
| 5839 | 5861 | CCTAACCCCTGTCTTTAGATTTA | 1448 | TAAATCTAAAGACAGGGGTT | 3217 |
| 5844 | 5866 | CCCCTGTCTTTAGATTTACAGTC | 1449 | GACTGTAAATCTAAAGACAG | 3218 |
| 5845 | 5867 | CCCTGTCTTTAGATTTACAGTCC | 1450 | GGACTGTAAATCTAAAGACA | 3219 |
| 5846 | 5868 | CCTGTCTTTAGATTTACAGTCCA | 1451 | TGGACTGTAAATCTAAAGAC | 3220 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 5866 | 5888 | CCAATGCTTCACTCAGCCATTTT | 1452 | AAAATGGCTGAGTGAAGCAT | 3221 |
| 5882 | 5904 | CCATTTTACCTCACCCCCACTGA | 1453 | TCAGTGGGGGTGAGGTAAAA | 3222 |
| 5890 | 5912 | CCTCACCCCCACTGATGTTCGCC | 1454 | GGCGAACATCAGTGGGGGTG | 3223 |
| 5895 | 5917 | CCCCCACTGATGTTCGCCGACCG | 1455 | CGGTCGGCGAACATCAGTGG | 3224 |
| 5896 | 5918 | CCCCACTGATGTTCGCCGACCGT | 1456 | ACGGTCGGCGAACATCAGTG | 3225 |
| 5897 | 5919 | CCCACTGATGTTCGCCGACCGTT | 1457 | AACGGTCGGCGAACATCAGT | 3226 |
| 5898 | 5920 | CCACTGATGTTCGCCGACCGTTG | 1458 | CAACGGTCGGCGAACATCAG | 3227 |
| 5911 | 5933 | CCGACCGTTGACTATTCTCTACA | 1459 | TGTAGAGAATAGTCAACGGT | 3228 |
| 5915 | 5937 | CCGTTGACTATTCTCTACAAACC | 1460 | GGTTTGTAGAGAATAGTCAA | 3229 |
| 5936 | 5958 | CCACAAAGACATTGGAACACTAT | 1461 | ATAGTGTTCCAATGTCTTTG | 3230 |
| 5960 | 5982 | CCTATTATTCGGCGCATGAGCTG | 1462 | CAGCTCATGCGCCGAATAAT | 3231 |
| 5987 | 6009 | CCTAGGCACAGCTCTAAGCCTCC | 1463 | GGAGGCTTAGAGCTGTGCCT | 3232 |
| 6005 | 6027 | CCTCCTTATTCGAGCCGAGCTGG | 1464 | CCAGCTCGGCTCGAATAAGG | 3233 |
| 6008 | 6030 | CCTTATTCGAGCCGAGCTGGGCC | 1465 | GGCCCAGCTCGGCTCGAATA | 3234 |
| 6019 | 6041 | CCGAGCTGGGCCAGCCAGGCAAC | 1466 | GTTGCCTGGCTGGCCCAGCT | 3235 |
| 6029 | 6051 | CCAGCCAGGCAACCTTCTAGGTA | 1467 | TACCTAGAAGGTTGCCTGGC | 3236 |
| 6033 | 6055 | CCAGGCAACCTTCTAGGTAACGA | 1468 | TCGTTACCTAGAAGGTTGCC | 3237 |
| 6041 | 6063 | CCTTCTAGGTAACGACCACATCT | 1469 | AGATGTGGTCGTTACCTAGA | 3238 |
| 6056 | 6078 | CCACATCTACAACGTTATCGTCA | 1470 | TGACGATAACGTTGTAGATG | 3239 |
| 6082 | 6104 | CCCATGCATTTGTAATAATCTTC | 1471 | GAAGATTATTACAAATGCAT | 3240 |
| 6083 | 6105 | CCATGCATTTGTAATAATCTTCT | 1472 | AGAAGATTATTACAAATGCA | 3241 |
| 6117 | 6139 | CCCATCATAATCGGAGGCTTTGG | 1473 | CCAAAGCCTCCGATTATGAT | 3242 |
| 6118 | 6140 | CCATCATAATCGGAGGCTTTGGC | 1474 | GCCAAAGCCTCCGATTATGA | 3243 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 6153 | 6175 | CCCCTAATAATCGGTGCCCCCGA | 1475 | TCGGGGGCACCGATTATTAG | 3244 |
| 6154 | 6176 | CCCTAATAATCGGTGCCCCGAT | 1476 | ATCGGGGCACCGATTATTA | 3245 |
| 6155 | 6177 | CCTAATAATCGGTGCCCCGATA | 1477 | TATCGGGGCACCGATTATT | 3246 |
| 6169 | 6191 | CCCCCGATATGGCGTTTCCCCGC | 1478 | GCGGGGAAACGCCATATCGG | 3247 |
| 6170 | 6192 | CCCCGATATGGCGTTTCCCGCA | 1479 | TGCGGGGAAACGCCATATCG | 3248 |
| 6171 | 6193 | CCCGATATGGCGTTTCCCCGCAT | 1480 | ATGCGGGGAAACGCCATATC | 3249 |
| 6172 | 6194 | CCGATATGGCGTTTCCCCGCATA | 1481 | TATGCGGGGAAACGCCATAT | 3250 |
| 6186 | 6208 | CCCCGCATAAACAACATAAGCTT | 1482 | AAGCTTATGTTGTTTATGCG | 3251 |
| 6187 | 6209 | CCCGCATAAACAACATAAGCTTC | 1483 | GAAGCTTATGTTGTTTATGC | 3252 |
| 6188 | 6210 | CCGCATAAACAACATAAGCTTCT | 1484 | AGAAGCTTATGTTGTTTATG | 3253 |
| 6219 | 6241 | CCTCCCTCTCTCCTACTCCTGCT | 1485 | AGCAGGAGTAGGAGAGAGGG | 3254 |
| 6222 | 6244 | CCCTCTCTCCTACTCCTGCTCGC | 1486 | GCGAGCAGGAGTAGGAGAGA | 3255 |
| 6223 | 6245 | CCTCTCTCCTACTCCTGCTCGCA | 1487 | TGCGAGCAGGAGTAGGAGAG | 3256 |
| 6230 | 6252 | CCTACTCCTGCTCGCATCTGCTA | 1488 | TAGCAGATGCGAGCAGGAGT | 3257 |
| 6236 | 6258 | CCTGCTCGCATCTGCTATAGTGG | 1489 | CCACTATAGCAGATGCGAGC | 3258 |
| 6262 | 6284 | CCGGAGCAGGAACAGGTTGAACA | 1490 | TGTTCAACCTGTTCCTGCTC | 3259 |
| 6290 | 6312 | CCCTCCCTTAGCAGGGAACTACT | 1491 | AGTAGTTCCCTGCTAAGGGA | 3260 |
| 6291 | 6313 | CCTCCCTTAGCAGGGAACTACTC | 1492 | GAGTAGTTCCCTGCTAAGGG | 3261 |
| 6294 | 6316 | CCCTTAGCAGGGAACTACTCCCA | 1493 | TGGGAGTAGTTCCCTGCTAA | 3262 |
| 6295 | 6317 | CCTTAGCAGGGAACTACTCCCAC | 1494 | GTGGGAGTAGTTCCCTGCTA | 3263 |
| 6313 | 6335 | CCCACCCTGGAGCCTCCGTAGAC | 1495 | GTCTACGGAGGCTCCAGGGT | 3264 |
| 6314 | 6336 | CCACCCTGGAGCCTCCGTAGACC | 1496 | GGTCTACGGAGGCTCCAGGG | 3265 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 6317 | 6339 | CCCTGGAGCCTCCGTAGACCTAA | 1497 | TTAGGTCTACGGAGGCTCCA | 3266 |
| 6318 | 6340 | CCTGGAGCCTCCGTAGACCTAAC | 1498 | GTTAGGTCTACGGAGGCTCC | 3267 |
| 6325 | 6347 | CCTCCGTAGACCTAACCATCTTC | 1499 | GAAGATGGTTAGGTCTACGG | 3268 |
| 6328 | 6350 | CCGTAGACCTAACCATCTTCTCC | 1500 | GGAGAAGATGGTTAGGTCTA | 3269 |
| 6335 | 6357 | CCTAACCATCTTCTCCTTACACC | 1501 | GGTGTAAGGAGAAGATGGTT | 3270 |
| 6340 | 6362 | CCATCTTCTCCTTACACCTAGCA | 1502 | TGCTAGGTGTAAGGAGAAGA | 3271 |
| 6349 | 6371 | CCTTACACCTAGCAGGTGTCTCC | 1503 | GGAGACACCTGCTAGGTGTA | 3272 |
| 6356 | 6378 | CCTAGCAGGTGTCTCCTCTATCT | 1504 | AGATAGAGGAGACACCTGCT | 3273 |
| 6370 | 6392 | CCTCTATCTTAGGGGCCATCAAT | 1505 | ATTGATGGCCCCTAAGATAG | 3274 |
| 6385 | 6407 | CCATCAATTTCATCACAACAATT | 1506 | AATTGTTGTGATGAAATTGA | 3275 |
| 6420 | 6442 | CCCCCTGCCATAACCCAATACCA | 1507 | TGGTATTGGGTTATGGCAGG | 3276 |
| 6421 | 6443 | CCCCTGCCATAACCCAATACCAA | 1508 | TTGGTATTGGGTTATGGCAG | 3277 |
| 6422 | 6444 | CCCTGCCATAACCCAATACCAAA | 1509 | TTTGGTATTGGGTTATGGCA | 3278 |
| 6423 | 6445 | CCTGCCATAACCCAATACCAAAC | 1510 | GTTTGGTATTGGGTTATGGC | 3279 |
| 6427 | 6449 | CCATAACCCAATACCAAACGCCC | 1511 | GGGCGTTTGGTATTGGGTTA | 3280 |
| 6433 | 6455 | CCCAATACCAAACGCCCCTCTTC | 1512 | GAAGAGGGGCGTTTGGTATT | 3281 |
| 6434 | 6456 | CCAATACCAAACGCCCCTCTTCG | 1513 | CGAAGAGGGGCGTTTGGTAT | 3282 |
| 6440 | 6462 | CCAAACGCCCCTCTTCGTCTGAT | 1514 | ATCAGACGAAGAGGGGCGTT | 3283 |
| 6447 | 6469 | CCCCTCTTCGTCTGATCCGTCCT | 1515 | AGGACGGATCAGACGAAGAG | 3284 |
| 6448 | 6470 | CCCTCTTCGTCTGATCCGTCCTA | 1516 | TAGGACGGATCAGACGAAGA | 3285 |
| 6449 | 6471 | CCTCTTCGTCTGATCCGTCCTAA | 1517 | TTAGGACGGATCAGACGAAG | 3286 |
| 6463 | 6485 | CCGTCCTAATCACAGCAGTCCTA | 1518 | TAGGACTGCTGTGATTAGGA | 3287 |
| 6467 | 6489 | CCTAATCACAGCAGTCCTACTTC | 1519 | GAAGTAGGACTGCTGTGATT | 3288 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 6482 | 6504 | CCTACTTCTCCTATCTCTCCCAG | 1520 | CTGGGAGAGATAGGAGAAGT | 3289 |
| 6491 | 6513 | CCTATCTCTCCCAGTCCTAGCTG | 1521 | CAGCTAGGACTGGGAGAGAT | 3290 |
| 6500 | 6522 | CCCAGTCCTAGCTGCTGGCATCA | 1522 | TGATGCCAGCAGCTAGGACT | 3291 |
| 6501 | 6523 | CCAGTCCTAGCTGCTGGCATCAC | 1523 | GTGATGCCAGCAGCTAGGAC | 3292 |
| 6506 | 6528 | CCTAGCTGCTGGCATCACTATAC | 1524 | GTATAGTGATGCCAGCAGCT | 3293 |
| 6539 | 6561 | CCGCAACCTCAACACCACCTTCT | 1525 | AGAAGGTGGTGTTGAGGTTG | 3294 |
| 6545 | 6567 | CCTCAACACCACCTTCTTCGACC | 1526 | GGTCGAAGAAGGTGGTGTTG | 3295 |
| 6553 | 6575 | CCACCTTCTTCGACCCCGCCGGA | 1527 | TCCGGCGGGGTCGAAGAAGG | 3296 |
| 6556 | 6578 | CCTTCTTCGACCCCGCCGGAGGA | 1528 | TCCTCCGGCGGGGTCGAAGA | 3297 |
| 6566 | 6588 | CCCCGCCGGAGGAGGAGACCCCA | 1529 | TGGGGTCTCCTCCTCCGGCG | 3298 |
| 6567 | 6589 | CCCGCCGGAGGAGGAGACCCCAT | 1530 | ATGGGGTCTCCTCCTCCGGC | 3299 |
| 6568 | 6590 | CCGCCGGAGGAGGAGACCCCATT | 1531 | AATGGGGTCTCCTCCTCCGG | 3300 |
| 6571 | 6593 | CCGGAGGAGGAGACCCCATTCTA | 1532 | TAGAATGGGGTCTCCTCCTC | 3301 |
| 6584 | 6606 | CCCCATTCTATACCAACACCTAT | 1533 | ATAGGTGTTGGTATAGAATG | 3302 |
| 6585 | 6607 | CCCATTCTATACCAACACCTATT | 1534 | AATAGGTGTTGGTATAGAAT | 3303 |
| 6586 | 6608 | CCATTCTATACCAACACCTATTC | 1535 | GAATAGGTGTTGGTATAGAA | 3304 |
| 6596 | 6618 | CCAACACCTATTCTGATTTTCG | 1536 | CGAAAAATCAGAATAGGTGT | 3305 |
| 6602 | 6624 | CCTATTCTGATTTTCGGTCACC | 1537 | GGTGACCGAAAAATCAGAAT | 3306 |
| 6623 | 6645 | CCCTGAAGTTTATATTCTTATCC | 1538 | GGATAAGAATATAAACTTCA | 3307 |
| 6624 | 6646 | CCTGAAGTTTATATTCTTATCCT | 1539 | AGGATAAGAATATAAACTTC | 3308 |
| 6644 | 6666 | CCTACCAGGCTTCGGAATAATCT | 1540 | AGATTATTCCGAAGCCTGGT | 3309 |
| 6648 | 6670 | CCAGGCTTCGGAATAATCTCCCA | 1541 | TGGGAGATTATTCCGAAGCC | 3310 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 6667 | 6689 | CCCATATTGTAACTTACTACTCC | 1542 | GGAGTAGTAAGTTACAATAT | 3311 |
| 6668 | 6690 | CCATATTGTAACTTACTACTCCG | 1543 | CGGAGTAGTAAGTTACAATA | 3312 |
| 6688 | 6710 | CCGGAAAAAAGAACCATTTGGA | 1544 | TCCAAATGGTTCTTTTTTTC | 3313 |
| 6702 | 6724 | CCATTTGGATACATAGGTATGGT | 1545 | ACCATACCTATGTATCCAAA | 3314 |
| 6749 | 6771 | CCTAGGGTTTATCGTGTGAGCAC | 1546 | GTGCTCACACGATAAACCCT | 3315 |
| 6773 | 6795 | CCATATATTTACAGTAGGAATAG | 1547 | CTATTCCTACTGTAAATATA | 3316 |
| 6820 | 6842 | CCTCCGCTACCATAATCATCGCT | 1548 | AGCGATGATTATGGTAGCGG | 3317 |
| 6823 | 6845 | CCGCTACCATAATCATCGCTATC | 1549 | GATAGCGATGATTATGGTAG | 3318 |
| 6829 | 6851 | CCATAATCATCGCTATCCCCACC | 1550 | GGTGGGGATAGCGATGATTA | 3319 |
| 6845 | 6867 | CCCCACCGGCGTCAAAGTATTTA | 1551 | TAAATACTTTGACGCCGGTG | 3320 |
| 6846 | 6868 | CCCACCGGCGTCAAAGTATTTAG | 1552 | CTAAATACTTTGACGCCGGT | 3321 |
| 6847 | 6869 | CCACCGGCGTCAAAGTATTTAGC | 1553 | GCTAAATACTTTGACGCCGG | 3322 |
| 6850 | 6872 | CCGGCGTCAAAGTATTTAGCTGA | 1554 | TCAGCTAAATACTTTGACGC | 3323 |
| 6877 | 6899 | CCACACTCCACGGAAGCAATATG | 1555 | CATATTGCTTCCGTGGAGTG | 3324 |
| 6884 | 6906 | CCACGGAAGCAATATGAAATGAT | 1556 | ATCATTTCATATTGCTTCCG | 3325 |
| 6925 | 6947 | CCCTAGGATTCATCTTTCTTTTC | 1557 | GAAAAGAAAGATGAATCCTA | 3326 |
| 6926 | 6948 | CCTAGGATTCATCTTTCTTTTCA | 1558 | TGAAAAGAAAGATGAATCCT | 3327 |
| 6949 | 6971 | CCGTAGGTGGCCTGACTGGCATT | 1559 | AATGCCAGTCAGGCCACCTA | 3328 |
| 6959 | 6981 | CCTGACTGGCATTGTATTAGCAA | 1560 | TTGCTAATACAATGCCAGTC | 3329 |
| 7027 | 7049 | CCCACTTCCACTATGTCCTATCA | 1561 | TGATAGGACATAGTGGAAGT | 3330 |
| 7028 | 7050 | CCACTTCCACTATGTCCTATCAA | 1562 | TTGATAGGACATAGTGGAAG | 3331 |
| 7034 | 7056 | CCACTATGTCCTATCAATAGGAG | 1563 | CTCCTATTGATAGGACATAG | 3332 |
| 7043 | 7065 | CCTATCAATAGGAGCTGTATTTG | 1564 | CAAATACAGCTCCTATTGAT | 3333 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 7066 | 7088 | CCATCATAGGAGGCTTCATTCAC | 1565 | GTGAATGAAGCCTCCTATGA | 3334 |
| 7095 | 7117 | CCCCTATTCTCAGGCTACACCCT | 1566 | AGGGTGTAGCCTGAGAATAG | 3335 |
| 7096 | 7118 | CCCTATTCTCAGGCTACACCCTA | 1567 | TAGGGTGTAGCCTGAGAATA | 3336 |
| 7097 | 7119 | CCTATTCTCAGGCTACACCCTAG | 1568 | CTAGGGTGTAGCCTGAGAAT | 3337 |
| 7114 | 7136 | CCCTAGACCAAACCTACGCCAAA | 1569 | TTTGGCGTAGGTTTGGTCTA | 3338 |
| 7115 | 7137 | CCTAGACCAAACCTACGCCAAAA | 1570 | TTTTGGCGTAGGTTTGGTCT | 3339 |
| 7121 | 7143 | CCAAACCTACGCCAAAATCCATT | 1571 | AATGGATTTTGGCGTAGGTT | 3340 |
| 7126 | 7148 | CCTACGCCAAAATCCATTTCACT | 1572 | AGTGAAATGGATTTTGGCGT | 3341 |
| 7132 | 7154 | CCAAAATCCATTTCACTATCATA | 1573 | TATGATAGTGAAATGGATTT | 3342 |
| 7139 | 7161 | CCATTTCACTATCATATTCATCG | 1574 | CGATGAATATGATAGTGAAA | 3343 |
| 7181 | 7203 | CCCACAACACTTTCTCGGCCTAT | 1575 | ATAGGCCGAGAAAGTGTTGT | 3344 |
| 7182 | 7204 | CCACAACACTTTCTCGGCCTATC | 1576 | GATAGGCCGAGAAAGTGTTG | 3345 |
| 7199 | 7221 | CCTATCCGGAATGCCCCGACGTT | 1577 | AACGTCGGGGCATTCCGGAT | 3346 |
| 7204 | 7226 | CCGGAATGCCCCGACGTTACTCG | 1578 | CGAGTAACGTCGGGGCATTC | 3347 |
| 7212 | 7234 | CCCCGACGTTACTCGGACTACCC | 1579 | GGGTAGTCCGAGTAACGTCG | 3348 |
| 7213 | 7235 | CCCGACGTTACTCGGACTACCCC | 1580 | GGGGTAGTCCGAGTAACGTC | 3349 |
| 7214 | 7236 | CCGACGTTACTCGGACTACCCCG | 1581 | CGGGGTAGTCCGAGTAACGT | 3350 |
| 7232 | 7254 | CCCCGATGCATACACCACATGAA | 1582 | TTCATGTGGTGTATGCATCG | 3351 |
| 7233 | 7255 | CCCGATGCATACACCACATGAAA | 1583 | TTTCATGTGGTGTATGCATC | 3352 |
| 7234 | 7256 | CCGATGCATACACCACATGAAAC | 1584 | GTTTCATGTGGTGTATGCAT | 3353 |
| 7246 | 7268 | CCACATGAAACATCCTATCATCT | 1585 | AGATGATAGGATGTTTCATG | 3354 |
| 7259 | 7281 | CCTATCATCTGTAGGCTCATTCA | 1586 | TGAATGAGCCTACAGATGAT | 3355 |
| 7327 | 7349 | CCTTCGCTTCGAAGCGAAAAGTC | 1587 | GACTTTTCGCTTCGAAGCGA | 3356 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 7349 | 7371 | CCTAATAGTAGAAGAACCCTCCA | 1588 | TGGAGGGTTCTTCTACTATT | 3357 |
| 7365 | 7387 | CCCTCCATAAACCTGGAGTGACT | 1589 | AGTCACTCCAGGTTTATGGA | 3358 |
| 7366 | 7388 | CCTCCATAAACCTGGAGTGACTA | 1590 | TAGTCACTCCAGGTTTATGG | 3359 |
| 7369 | 7391 | CCATAAACCTGGAGTGACTATAT | 1591 | ATATAGTCACTCCAGGTTTA | 3360 |
| 7376 | 7398 | CCTGGAGTGACTATATGGATGCC | 1592 | GGCATCCATATAGTCACTCC | 3361 |
| 7397 | 7419 | CCCCCCACCCTACCACACATTCG | 1593 | CGAATGTGTGGTAGGGTGGG | 3362 |
| 7398 | 7420 | CCCCCACCCTACCACACATTCGA | 1594 | TCGAATGTGTGGTAGGGTGG | 3363 |
| 7399 | 7421 | CCCCACCCTACCACACATTCGAA | 1595 | TTCGAATGTGTGGTAGGGTG | 3364 |
| 7400 | 7422 | CCCACCCTACCACACATTCGAAG | 1596 | CTTCGAATGTGTGGTAGGGT | 3365 |
| 7401 | 7423 | CCACCCTACCACACATTCGAAGA | 1597 | TCTTCGAATGTGTGGTAGGG | 3366 |
| 7404 | 7426 | CCCTACCACACATTCGAAGAACC | 1598 | GGTTCTTCGAATGTGTGGTA | 3367 |
| 7405 | 7427 | CCTACCACACATTCGAAGAACCC | 1599 | GGGTTCTTCGAATGTGTGGT | 3368 |
| 7409 | 7431 | CCACACATTCGAAGAACCCGTAT | 1600 | ATACGGGTTCTTCGAATGTG | 3369 |
| 7425 | 7447 | CCCGTATACATAAAATCTAGACA | 1601 | TGTCTAGATTTTATGTATAC | 3370 |
| 7426 | 7448 | CCGTATACATAAAATCTAGACAA | 1602 | TTGTCTAGATTTTATGTATA | 3371 |
| 7466 | 7488 | CCCCCCAAAGCTGGTTTCAAGCC | 1603 | GGCTTGAAACCAGCTTTGGG | 3372 |
| 7467 | 7489 | CCCCCAAAGCTGGTTTCAAGCCA | 1604 | TGGCTTGAAACCAGCTTTGG | 3373 |
| 7468 | 7490 | CCCCAAAGCTGGTTTCAAGCCAA | 1605 | TTGGCTTGAAACCAGCTTTG | 3374 |
| 7469 | 7491 | CCCAAAGCTGGTTTCAAGCCAAC | 1606 | GTTGGCTTGAAACCAGCTTT | 3375 |
| 7470 | 7492 | CCAAAGCTGGTTTCAAGCCAACC | 1607 | GGTTGGCTTGAAACCAGCTT | 3376 |
| 7487 | 7509 | CCAACCCCATGGCCTCCATGACT | 1608 | AGTCATGGAGGCCATGGGGT | 3377 |
| 7491 | 7513 | CCCCATGGCCTCCATGACTTTTT | 1609 | AAAAAGTCATGGAGGCCATG | 3378 |
| 7492 | 7514 | CCCATGGCCTCCATGACTTTTTC | 1610 | GAAAAAGTCATGGAGGCCAT | 3379 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 7493 | 7515 | CCATGGCCTCCATGACTTTTTCA | 1611 | TGAAAAAGTCATGGAGGCCA | 3380 |
| 7499 | 7521 | CCTCCATGACTTTTTCAAAAGG | 1612 | CCTTTTTGAAAAAGTCATGG | 3381 |
| 7502 | 7524 | CCATGACTTTTTCAAAAAGGTAT | 1613 | ATACCTTTTTGAAAAAGTCA | 3382 |
| 7533 | 7555 | CCATTTCATAACTTTGTCAAAGT | 1614 | ACTTTGACAAAGTTATGAAA | 3383 |
| 7573 | 7595 | CCTATATATCTTAATGGCACATG | 1615 | CATGTGCCATTAAGATATAT | 3384 |
| 7626 | 7648 | CCCCTATCATAGAAGAGCTTATC | 1616 | GATAAGCTCTTCTATGATAG | 3385 |
| 7627 | 7649 | CCCTATCATAGAAGAGCTTATCA | 1617 | TGATAAGCTCTTCTATGATA | 3386 |
| 7628 | 7650 | CCTATCATAGAAGAGCTTATCAC | 1618 | GTGATAAGCTCTTCTATGAT | 3387 |
| 7650 | 7672 | CCTTTCATGATCACGCCCTCATA | 1619 | TATGAGGGCGTGATCATGAA | 3388 |
| 7665 | 7687 | CCCTCATAATCATTTTCCTTATC | 1620 | GATAAGGAAAATGATTATGA | 3389 |
| 7666 | 7688 | CCTCATAATCATTTTCCTTATCT | 1621 | AGATAAGGAAAATGATTATG | 3390 |
| 7681 | 7703 | CCTTATCTGCTTCCTAGTCCTGT | 1622 | ACAGGACTAGGAAGCAGATA | 3391 |
| 7693 | 7715 | CCTAGTCCTGTATGCCCTTTTCC | 1623 | GGAAAAGGGCATACAGGACT | 3392 |
| 7699 | 7721 | CCTGTATGCCCTTTTCCTAACAC | 1624 | GTGTTAGGAAAAGGGCATAC | 3393 |
| 7707 | 7729 | CCCTTTTCCTAACACTCACAACA | 1625 | TGTTGTGAGTGTTAGGAAAA | 3394 |
| 7708 | 7730 | CCTTTTCCTAACACTCACAACAA | 1626 | TTGTTGTGAGTGTTAGGAAA | 3395 |
| 7714 | 7736 | CCTAACACTCACAACAAAACTAA | 1627 | TTAGTTTTGTTGTGAGTGTT | 3396 |
| 7773 | 7795 | CCGTCTGAACTATCCTGCCCGCC | 1628 | GGCGGGCAGGATAGTTCAGA | 3397 |
| 7786 | 7808 | CCTGCCCGCCATCATCCTAGTCC | 1629 | GGACTAGGATGATGGCGGGC | 3398 |
| 7790 | 7812 | CCCGCCATCATCCTAGTCCTCAT | 1630 | ATGAGGACTAGGATGATGGC | 3399 |
| 7791 | 7813 | CCGCCATCATCCTAGTCCTCATC | 1631 | GATGAGGACTAGGATGATGG | 3400 |
| 7794 | 7816 | CCATCATCCTAGTCCTCATCGCC | 1632 | GGCGATGAGGACTAGGATGA | 3401 |
| 7801 | 7823 | CCTAGTCCTCATCGCCCTCCCAT | 1633 | ATGGGAGGGCGATGAGGACT | 3402 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 7807 | 7829 | CCTCATCGCCCTCCCATCCCTAC | 1634 | GTAGGGATGGGAGGGCGATG | 3403 |
| 7815 | 7837 | CCCTCCCATCCCTACGCATCCTT | 1635 | AAGGATGCGTAGGGATGGGA | 3404 |
| 7816 | 7838 | CCTCCCATCCCTACGCATCCTTT | 1636 | AAAGGATGCGTAGGGATGGG | 3405 |
| 7819 | 7841 | CCCATCCCTACGCATCCTTTACA | 1637 | TGTAAAGGATGCGTAGGGAT | 3406 |
| 7820 | 7842 | CCATCCCTACGCATCCTTTACAT | 1638 | ATGTAAAGGATGCGTAGGGA | 3407 |
| 7824 | 7846 | CCCTACGCATCCTTTACATAACA | 1639 | TGTTATGTAAAGGATGCGTA | 3408 |
| 7825 | 7847 | CCTACGCATCCTTTACATAACAG | 1640 | CTGTTATGTAAAGGATGCGT | 3409 |
| 7834 | 7856 | CCTTTACATAACAGACGAGGTCA | 1641 | TGACCTCGTCTGTTATGTAA | 3410 |
| 7862 | 7884 | CCCTCCCTTACCATCAAATCAAT | 1642 | ATTGATTTGATGGTAAGGGA | 3411 |
| 7863 | 7885 | CCTCCCTTACCATCAAATCAATT | 1643 | AATTGATTTGATGGTAAGGG | 3412 |
| 7866 | 7888 | CCCTTACCATCAAATCAATTGGC | 1644 | GCCAATTGATTTGATGGTAA | 3413 |
| 7867 | 7889 | CCTTACCATCAAATCAATTGGCC | 1645 | GGCCAATTGATTTGATGGTA | 3414 |
| 7872 | 7894 | CCATCAAATCAATTGGCCACCAA | 1646 | TTGGTGGCCAATTGATTTGA | 3415 |
| 7888 | 7910 | CCACCAATGGTACTGAACCTACG | 1647 | CGTAGGTTCAGTACCATTGG | 3416 |
| 7891 | 7913 | CCAATGGTACTGAACCTACGAGT | 1648 | ACTCGTAGGTTCAGTACCAT | 3417 |
| 7905 | 7927 | CCTACGAGTACACCGACTACGGC | 1649 | GCCGTAGTCGGTGTACTCGT | 3418 |
| 7917 | 7939 | CCGACTACGGCGGACTAATCTTC | 1650 | GAAGATTAGTCCGCCGTAGT | 3419 |
| 7944 | 7966 | CCTACATACTTCCCCCATTATTC | 1651 | GAATAATGGGGGAAGTATGT | 3420 |
| 7955 | 7977 | CCCCCATTATTCCTAGAACCAGG | 1652 | CCTGGTTCTAGGAATAATGG | 3421 |
| 7956 | 7978 | CCCCATTATTCCTAGAACCAGGC | 1653 | GCCTGGTTCTAGGAATAATG | 3422 |
| 7957 | 7979 | CCCATTATTCCTAGAACCAGGCG | 1654 | CGCCTGGTTCTAGGAATAAT | 3423 |
| 7958 | 7980 | CCATTATTCCTAGAACCAGGCGA | 1655 | TCGCCTGGTTCTAGGAATAA | 3424 |
| 7966 | 7988 | CCTAGAACCAGGCGACCTGCGAC | 1656 | GTCGCAGGTCGCCTGGTTCT | 3425 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 7973 | 7995 | CCAGGCGACCTGCGACTCCTTGA | 1657 | TCAAGGAGTCGCAGGTCGCC | 3426 |
| 7981 | 8003 | CCTGCGACTCCTTGACGTTGACA | 1658 | TGTCAACGTCAAGGAGTCGC | 3427 |
| 7990 | 8012 | CCTTGACGTTGACAATCGAGTAG | 1659 | CTACTCGATTGTCAACGTCA | 3428 |
| 8017 | 8039 | CCCGATTGAAGCCCCCATTCGTA | 1660 | TACGAATGGGGCTTCAATC | 3429 |
| 8018 | 8040 | CCGATTGAAGCCCCCATTCGTAT | 1661 | ATACGAATGGGGCTTCAAT | 3430 |
| 8028 | 8050 | CCCCCATTCGTATAATAATTACA | 1662 | TGTAATTATTATACGAATGG | 3431 |
| 8029 | 8051 | CCCCATTCGTATAATAATTACAT | 1663 | ATGTAATTATTATACGAATG | 3432 |
| 8030 | 8052 | CCCATTCGTATAATAATTACATC | 1664 | GATGTAATTATTATACGAAT | 3433 |
| 8031 | 8053 | CCATTCGTATAATAATTACATCA | 1665 | TGATGTAATTATTATACGAA | 3434 |
| 8080 | 8102 | CCCCACATTAGGCTTAAAAACAG | 1666 | CTGTTTTAAGCCTAATGTG | 3435 |
| 8081 | 8103 | CCCACATTAGGCTTAAAAACAGA | 1667 | TCTGTTTTAAGCCTAATGT | 3436 |
| 8082 | 8104 | CCACATTAGGCTTAAAAACAGAT | 1668 | ATCTGTTTTAAGCCTAATG | 3437 |
| 8111 | 8133 | CCCGGACGTCTAAACCAAACCAC | 1669 | GTGGTTTGGTTTAGACGTCC | 3438 |
| 8112 | 8134 | CCGGACGTCTAAACCAAACCACT | 1670 | AGTGGTTTGGTTTAGACGTC | 3439 |
| 8125 | 8147 | CCAAACCACTTTCACCGCTACAC | 1671 | GTGTAGCGGTGAAAGTGGTT | 3440 |
| 8130 | 8152 | CCACTTTCACCGCTACACGACCG | 1672 | CGGTCGTGTAGCGGTGAAAG | 3441 |
| 8139 | 8161 | CCGCTACACGACCGGGGTATAC | 1673 | GTATACCCCGGTCGTGTAG | 3442 |
| 8150 | 8172 | CCGGGGTATACTACGGTCAATG | 1674 | CATTGACCGTAGTATACCCC | 3443 |
| 8194 | 8216 | CCACAGTTTCATGCCCATCGTCC | 1675 | GGACGATGGGCATGAAACTG | 3444 |
| 8207 | 8229 | CCCATCGTCCTAGAATTAATTCC | 1676 | GGAATTAATTCTAGGACGAT | 3445 |
| 8208 | 8230 | CCATCGTCCTAGAATTAATTCCC | 1677 | GGGAATTAATTCTAGGACGA | 3446 |
| 8215 | 8237 | CCTAGAATTAATTCCCCTAAAAA | 1678 | TTTTTAGGGGAATTAATTCT | 3447 |
| 8228 | 8250 | CCCCTAAAAATCTTTGAAATAGG | 1679 | CCTATTTCAAAGATTTTTAG | 3448 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 8229 | 8251 | CCCTAAAAATCTTTGAAATAGGG | 1680 | CCCTATTTCAAAGATTTTTA | 3449 |
| 8230 | 8252 | CCTAAAAATCTTTGAAATAGGGC | 1681 | GCCCTATTTCAAAGATTTTT | 3450 |
| 8252 | 8274 | CCCGTATTTACCCTATAGCACCC | 1682 | GGGTGCTATAGGGTAAATAC | 3451 |
| 8253 | 8275 | CCGTATTTACCCTATAGCACCCC | 1683 | GGGGTGCTATAGGGTAAATA | 3452 |
| 8262 | 8284 | CCCTATAGCACCCCCTCTACCCC | 1684 | GGGGTAGAGGGGGTGCTATA | 3453 |
| 8263 | 8285 | CCTATAGCACCCCCTCTACCCCC | 1685 | GGGGGTAGAGGGGGTGCTAT | 3454 |
| 8272 | 8294 | CCCCCTCTACCCCCTCTAGAGCC | 1686 | GGCTCTAGAGGGGTAGAGG | 3455 |
| 8273 | 8295 | CCCCTCTACCCCCTCTAGAGCCC | 1687 | GGGCTCTAGAGGGGGTAGAG | 3456 |
| 8274 | 8296 | CCCTCTACCCCCTCTAGAGCCCA | 1688 | TGGGCTCTAGAGGGGGTAGA | 3457 |
| 8275 | 8297 | CCTCTACCCCCTCTAGAGCCCAC | 1689 | GTGGGCTCTAGAGGGGGTAG | 3458 |
| 8281 | 8303 | CCCCCTCTAGAGCCCACTGTAAA | 1690 | TTTACAGTGGGCTCTAGAGG | 3459 |
| 8282 | 8304 | CCCCTCTAGAGCCCACTGTAAAG | 1691 | CTTTACAGTGGGCTCTAGAG | 3460 |
| 8283 | 8305 | CCCTCTAGAGCCCACTGTAAAGC | 1692 | GCTTTACAGTGGGCTCTAGA | 3461 |
| 8284 | 8306 | CCTCTAGAGCCCACTGTAAAGCT | 1693 | AGCTTTACAGTGGGCTCTAG | 3462 |
| 8293 | 8315 | CCCACTGTAAAGCTAACTTAGCA | 1694 | TGCTAAGTTAGCTTTACAGT | 3463 |
| 8294 | 8316 | CCACTGTAAAGCTAACTTAGCAT | 1695 | ATGCTAAGTTAGCTTTACAG | 3464 |
| 8320 | 8342 | CCTTTTAAGTTAAAGATTAAGAG | 1696 | CTCTTAATCTTTAACTTAAA | 3465 |
| 8345 | 8367 | CCAACACCTCTTTACAGTGAAAT | 1697 | ATTTCACTGTAAAGAGGTGT | 3466 |
| 8351 | 8373 | CCTCTTTACAGTGAAATGCCCCA | 1698 | TGGGGCATTTCACTGTAAAG | 3467 |
| 8369 | 8391 | CCCCAACTAAATACTACCGTATG | 1699 | CATACGGTAGTATTTAGTTG | 3468 |
| 8370 | 8392 | CCCAACTAAATACTACCGTATGG | 1700 | CCATACGGTAGTATTTAGTT | 3469 |
| 8371 | 8393 | CCAACTAAATACTACCGTATGGC | 1701 | GCCATACGGTAGTATTTAGT | 3470 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 8385 | 8407 | CCGTATGGCCCACCATAATTACC | 1702 | GGTAATTATGGTGGGCCATA | 3471 |
| 8393 | 8415 | CCCACCATAATTACCCCCATACT | 1703 | AGTATGGGGGTAATTATGGT | 3472 |
| 8394 | 8416 | CCACCATAATTACCCCCATACTC | 1704 | GAGTATGGGGTAATTATGG | 3473 |
| 8397 | 8419 | CCATAATTACCCCCATACTCCTT | 1705 | AAGGAGTATGGGGGTAATTA | 3474 |
| 8406 | 8428 | CCCCCATACTCCTTACACTATTC | 1706 | GAATAGTGTAAGGAGTATGG | 3475 |
| 8407 | 8429 | CCCCATACTCCTTACACTATTCC | 1707 | GGAATAGTGTAAGGAGTATG | 3476 |
| 8408 | 8430 | CCCATACTCCTTACACTATTCCT | 1708 | AGGAATAGTGTAAGGAGTAT | 3477 |
| 8409 | 8431 | CCATACTCCTTACACTATTCCTC | 1709 | GAGGAATAGTGTAAGGAGTA | 3478 |
| 8416 | 8438 | CCTTACACTATTCCTCATCACCC | 1710 | GGGTGATGAGGAATAGTGTA | 3479 |
| 8428 | 8450 | CCTCATCACCCAACTAAAATAT | 1711 | ATATTTTAGTTGGGTGATG | 3480 |
| 8436 | 8458 | CCCAACTAAAAATATTAAACACA | 1712 | TGTGTTTAATATTTTAGTT | 3481 |
| 8437 | 8459 | CCAACTAAAAATATTAAACACAA | 1713 | TTGTGTTTAATATTTTTAGT | 3482 |
| 8464 | 8486 | CCACCTACCTCCCTCACCAAAGC | 1714 | GCTTTGGTGAGGGAGGTAGG | 3483 |
| 8467 | 8489 | CCTACCTCCCTCACCAAAGCCCA | 1715 | TGGGCTTTGGTGAGGGAGGT | 3484 |
| 8471 | 8493 | CCTCCCTCACCAAAGCCCATAAA | 1716 | TTTATGGGCTTTGGTGAGGG | 3485 |
| 8474 | 8496 | CCCTCACCAAAGCCCATAAAAAT | 1717 | ATTTTTATGGGCTTTGGTGA | 3486 |
| 8475 | 8497 | CCTCACCAAAGCCCATAAAATA | 1718 | TATTTTTATGGGCTTTGGTG | 3487 |
| 8480 | 8502 | CCAAAGCCCATAAAAATAAAAAA | 1719 | TTTTTATTTTTATGGGCTT | 3488 |
| 8486 | 8508 | CCCATAAAAATAAAAATTATAA | 1720 | TTATAATTTTTATTTTTAT | 3489 |
| 8487 | 8509 | CCATAAAAATAAAAATTATAAC | 1721 | GTTATAATTTTTATTTTTA | 3490 |
| 8513 | 8535 | CCCTGAGAACCAAAATGAACGAA | 1722 | TTCGTTCATTTTGGTTCTCA | 3491 |
| 8514 | 8536 | CCTGAGAACCAAAATGAACGAAA | 1723 | TTTCGTTCATTTTGGTTCTC | 3492 |
| 8522 | 8544 | CCAAAATGAACGAAAATCTGTTC | 1724 | GAACAGATTTTCGTTCATTT | 3493 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 8558 | 8580 | CCCCCACAATCCTAGGCCTACCC | 1725 | GGGTAGGCCTAGGATTGTGG | 3494 |
| 8559 | 8581 | CCCCACAATCCTAGGCCTACCCG | 1726 | CGGGTAGGCCTAGGATTGTG | 3495 |
| 8560 | 8582 | CCCACAATCCTAGGCCTACCCGC | 1727 | GCGGGTAGGCCTAGGATTGT | 3496 |
| 8561 | 8583 | CCACAATCCTAGGCCTACCCGCC | 1728 | GGCGGGTAGGCCTAGGATTG | 3497 |
| 8568 | 8590 | CCTAGGCCTACCCGCCGCAGTAC | 1729 | GTACTGCGGCGGGTAGGCCT | 3498 |
| 8574 | 8596 | CCTACCCGCCGCAGTACTGATCA | 1730 | TGATCAGTACTGCGGCGGGT | 3499 |
| 8578 | 8600 | CCCGCCGCAGTACTGATCATTCT | 1731 | AGAATGATCAGTACTGCGGC | 3500 |
| 8579 | 8601 | CCGCCGCAGTACTGATCATTCTA | 1732 | TAGAATGATCAGTACTGCGG | 3501 |
| 8582 | 8604 | CCGCAGTACTGATCATTCTATTT | 1733 | AAATAGAATGATCAGTACTG | 3502 |
| 8605 | 8627 | CCCCCTCTATTGATCCCCACCTC | 1734 | GAGGTGGGGATCAATAGAGG | 3503 |
| 8606 | 8628 | CCCCTCTATTGATCCCCACCTCC | 1735 | GGAGGTGGGGATCAATAGAG | 3504 |
| 8607 | 8629 | CCCTCTATTGATCCCCACCTCCA | 1736 | TGGAGGTGGGGATCAATAGA | 3505 |
| 8608 | 8630 | CCTCTATTGATCCCCACCTCCAA | 1737 | TTGGAGGTGGGGATCAATAG | 3506 |
| 8619 | 8641 | CCCCACCTCCAAATATCTCATCA | 1738 | TGATGAGATATTTGGAGGTG | 3507 |
| 8620 | 8642 | CCCACCTCCAAATATCTCATCAA | 1739 | TTGATGAGATATTTGGAGGT | 3508 |
| 8621 | 8643 | CCACCTCCAAATATCTCATCAAC | 1740 | GTTGATGAGATATTTGGAGG | 3509 |
| 8624 | 8646 | CCTCCAAATATCTCATCAACAAC | 1741 | GTTGTTGATGAGATATTTGG | 3510 |
| 8627 | 8649 | CCAAATATCTCATCAACAACCGA | 1742 | TCGGTTGTTGATGAGATATT | 3511 |
| 8646 | 8668 | CCGACTAATCACCACCCAACAAT | 1743 | ATTGTTGGGTGGTGATTAGT | 3512 |
| 8657 | 8679 | CCACCCAACAATGACTAATCAAA | 1744 | TTTGATTAGTCATTGTTGGG | 3513 |
| 8660 | 8682 | CCCAACAATGACTAATCAAACTA | 1745 | TAGTTTGATTAGTCATTGTT | 3514 |
| 8661 | 8683 | CCAACAATGACTAATCAAACTAA | 1746 | TTAGTTTGATTAGTCATTGT | 3515 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 8684 | 8706 | CCTCAAAACAAATGATAACCATA | 1747 | TATGGTTATCATTTGTTTTG | 3516 |
| 8702 | 8724 | CCATACACAACACTAAAGGACGA | 1748 | TCGTCCTTTAGTGTTGTGTA | 3517 |
| 8726 | 8748 | CCTGATCTCTTATACTAGTATCC | 1749 | GGATACTAGTATAAGAGATC | 3518 |
| 8747 | 8769 | CCTTAATCATTTTTATTGCCACA | 1750 | TGTGGCAATAAAAATGATTA | 3519 |
| 8765 | 8787 | CCACAACTAACCTCCTCGGACTC | 1751 | GAGTCCGAGGAGGTTAGTTG | 3520 |
| 8775 | 8797 | CCTCCTCGGACTCCTGCCTCACT | 1752 | AGTGAGGCAGGAGTCCGAGG | 3521 |
| 8778 | 8800 | CCTCGGACTCCTGCCTCACTCAT | 1753 | ATGAGTGAGGCAGGAGTCCG | 3522 |
| 8787 | 8809 | CCTGCCTCACTCATTTACACCAA | 1754 | TTGGTGTAAATGAGTGAGGC | 3523 |
| 8791 | 8813 | CCTCACTCATTTACACCAACCAC | 1755 | GTGGTTGGTGTAAATGAGTG | 3524 |
| 8806 | 8828 | CCAACCACCCAACTATCTATAAA | 1756 | TTTATAGATAGTTGGGTGGT | 3525 |
| 8810 | 8832 | CCACCCAACTATCTATAAACCTA | 1757 | TAGGTTTATAGATAGTTGGG | 3526 |
| 8813 | 8835 | CCCAACTATCTATAAACCTAGCC | 1758 | GGCTAGGTTTATAGATAGTT | 3527 |
| 8814 | 8836 | CCAACTATCTATAAACCTAGCCA | 1759 | TGGCTAGGTTTATAGATAGT | 3528 |
| 8829 | 8851 | CCTAGCCATGGCCATCCCCTTAT | 1760 | ATAAGGGGATGGCCATGGCT | 3529 |
| 8834 | 8856 | CCATGGCCATCCCCTTATGAGCG | 1761 | CGCTCATAAGGGGATGGCCA | 3530 |
| 8840 | 8862 | CCATCCCCTTATGAGCGGGCACA | 1762 | TGTGCCCGCTCATAAGGGGA | 3531 |
| 8844 | 8866 | CCCCTTATGAGCGGGCACAGTGA | 1763 | TCACTGTGCCCGCTCATAAG | 3532 |
| 8845 | 8867 | CCCTTATGAGCGGGCACAGTGAT | 1764 | ATCACTGTGCCCGCTCATAA | 3533 |
| 8846 | 8868 | CCTTATGAGCGGGCACAGTGATT | 1765 | AATCACTGTGCCCGCTCATA | 3534 |
| 8897 | 8919 | CCCTAGCCCACTTCTTACCACAA | 1766 | TTGTGGTAAGAAGTGGGCTA | 3535 |
| 8898 | 8920 | CCTAGCCCACTTCTTACCACAAG | 1767 | CTTGTGGTAAGAAGTGGGCT | 3536 |
| 8903 | 8925 | CCCACTTCTTACCACAAGGCACA | 1768 | TGTGCCTTGTGGTAAGAAGT | 3537 |
| 8904 | 8926 | CCACTTCTTACCACAAGGCACAC | 1769 | GTGTGCCTTGTGGTAAGAAG | 3538 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 8914 | 8936 | CCACAAGGCACACCTACACCCCT | 1770 | AGGGGTGTAGGTGTGCCTTG | 3539 |
| 8926 | 8948 | CCTACACCCCTTATCCCCATACT | 1771 | AGTATGGGGATAAGGGGTGT | 3540 |
| 8932 | 8954 | CCCCTTATCCCCATACTAGTTAT | 1772 | ATAACTAGTATGGGGATAAG | 3541 |
| 8933 | 8955 | CCCTTATCCCCATACTAGTTATT | 1773 | AATAACTAGTATGGGGATAA | 3542 |
| 8934 | 8956 | CCTTATCCCCATACTAGTTATTA | 1774 | TAATAACTAGTATGGGGATA | 3543 |
| 8940 | 8962 | CCCCATACTAGTTATTATCGAAA | 1775 | TTTCGATAATAACTAGTATG | 3544 |
| 8941 | 8963 | CCCATACTAGTTATTATCGAAAC | 1776 | GTTTCGATAATAACTAGTAT | 3545 |
| 8942 | 8964 | CCATACTAGTTATTATCGAAACC | 1777 | GGTTTCGATAATAACTAGTA | 3546 |
| 8963 | 8985 | CCATCAGCCTACTCATTCAACCA | 1778 | TGGTTGAATGAGTAGGCTGA | 3547 |
| 8970 | 8992 | CCTACTCATTCAACCAATAGCCC | 1779 | GGGCTATTGGTTGAATGAGT | 3548 |
| 8983 | 9005 | CCAATAGCCCTGGCCGTACGCCT | 1780 | AGGCGTACGGCCAGGGCTAT | 3549 |
| 8990 | 9012 | CCCTGGCCGTACGCCTAACCGCT | 1781 | AGCGGTTAGGCGTACGGCCA | 3550 |
| 8991 | 9013 | CCTGGCCGTACGCCTAACCGCTA | 1782 | TAGCGGTTAGGCGTACGGCC | 3551 |
| 8996 | 9018 | CCGTACGCCTAACCGCTAACATT | 1783 | AATGTTAGCGGTTAGGCGTA | 3552 |
| 9003 | 9025 | CCTAACCGCTAACATTACTGCAG | 1784 | CTGCAGTAATGTTAGCGGTT | 3553 |
| 9008 | 9030 | CCGCTAACATTACTGCAGGCCAC | 1785 | GTGGCCTGCAGTAATGTTAG | 3554 |
| 9027 | 9049 | CCACCTACTCATGCACCTAATTG | 1786 | CAATTAGGTGCATGAGTAGG | 3555 |
| 9030 | 9052 | CCTACTCATGCACCTAATTGGAA | 1787 | TTCCAATTAGGTGCATGAGT | 3556 |
| 9042 | 9064 | CCTAATTGGAAGCGCCACCCTAG | 1788 | CTAGGGTGGCGCTTCCAATT | 3557 |
| 9056 | 9078 | CCACCCTAGCAATATCAACCATT | 1789 | AATGGTTGATATTGCTAGGG | 3558 |
| 9059 | 9081 | CCCTAGCAATATCAACCATTAAC | 1790 | GTTAATGGTTGATATTGCTA | 3559 |
| 9060 | 9082 | CCTAGCAATATCAACCATTAACC | 1791 | GGTTAATGGTTGATATTGCT | 3560 |
| 9074 | 9096 | CCATTAACCTTCCCTCTACACTT | 1792 | AAGTGTAGAGGGAAGGTTAA | 3561 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 9081 | 9103 | CCTTCCCTCTACACTTATCATCT | 1793 | AGATGATAAGTGTAGAGGGA | 3562 |
| 9085 | 9107 | CCCTCTACACTTATCATCTTCAC | 1794 | GTGAAGATGATAAGTGTAGA | 3563 |
| 9086 | 9108 | CCTCTACACTTATCATCTTCACA | 1795 | TGTGAAGATGATAAGTGTAG | 3564 |
| 9129 | 9151 | CCTAGAAATCGCTGTCGCCTTAA | 1796 | TTAAGGCGACAGCGATTTCT | 3565 |
| 9146 | 9168 | CCTTAATCCAAGCCTACGTTTTC | 1797 | GAAAACGTAGGCTTGGATTA | 3566 |
| 9153 | 9175 | CCAAGCCTACGTTTTCACACTTC | 1798 | GAAGTGTGAAAACGTAGGCT | 3567 |
| 9158 | 9180 | CCTACGTTTTCACACTTCTAGTA | 1799 | TACTAGAAGTGTGAAAACGT | 3568 |
| 9183 | 9205 | CCTCTACCTGCACGACAACACAT | 1800 | ATGTGTTGTCGTGCAGGTAG | 3569 |
| 9189 | 9211 | CCTGCACGACAACACATAATGAC | 1801 | GTCATTATGTGTTGTCGTGC | 3570 |
| 9211 | 9233 | CCCACCAATCACATGCCTATCAT | 1802 | ATGATAGGCATGTGATTGGT | 3571 |
| 9212 | 9234 | CCACCAATCACATGCCTATCATA | 1803 | TATGATAGGCATGTGATTGG | 3572 |
| 9215 | 9237 | CCAATCACATGCCTATCATATAG | 1804 | CTATATGATAGGCATGTGAT | 3573 |
| 9226 | 9248 | CCTATCATATAGTAAAACCCAGC | 1805 | GCTGGGTTTTACTATATGAT | 3574 |
| 9243 | 9265 | CCCAGCCCATGACCCCTAACAGG | 1806 | CCTGTTAGGGGTCATGGGCT | 3575 |
| 9244 | 9266 | CCAGCCCATGACCCCTAACAGGG | 1807 | CCCTGTTAGGGGTCATGGGC | 3576 |
| 9248 | 9270 | CCCATGACCCCTAACAGGGGCCC | 1808 | GGGCCCCTGTTAGGGGTCAT | 3577 |
| 9249 | 9271 | CCATGACCCCTAACAGGGGCCCT | 1809 | AGGGCCCCTGTTAGGGGTCA | 3578 |
| 9255 | 9277 | CCCCTAACAGGGGCCCTCTCAGC | 1810 | GCTGAGAGGGCCCCTGTTAG | 3579 |
| 9256 | 9278 | CCCTAACAGGGGCCCTCTCAGCC | 1811 | GGCTGAGAGGGCCCCTGTTA | 3580 |
| 9257 | 9279 | CCTAACAGGGGCCCTCTCAGCCC | 1812 | GGGCTGAGAGGGCCCCTGTT | 3581 |
| 9268 | 9290 | CCCTCTCAGCCCTCCTAATGACC | 1813 | GGTCATTAGGAGGGCTGAGA | 3582 |
| 9269 | 9291 | CCTCTCAGCCCTCCTAATGACCT | 1814 | AGGTCATTAGGAGGGCTGAG | 3583 |
| 9277 | 9299 | CCCTCCTAATGACCTCCGGCCTA | 1815 | TAGGCCGGAGGTCATTAGGA | 3584 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 9278 | 9300 | CCTCCTAATGACCTCCGGCCTAG | 1816 | CTAGGCCGGAGGTCATTAGG | 3585 |
| 9281 | 9303 | CCTAATGACCTCCGGCCTAGCCA | 1817 | TGGCTAGGCCGGAGGTCATT | 3586 |
| 9289 | 9311 | CCTCCGGCCTAGCCATGTGATTT | 1818 | AAATCACATGGCTAGGCCGG | 3587 |
| 9292 | 9314 | CCGGCCTAGCCATGTGATTTCAC | 1819 | GTGAAATCACATGGCTAGGC | 3588 |
| 9296 | 9318 | CCTAGCCATGTGATTTCACTTCC | 1820 | GGAAGTGAAATCACATGGCT | 3589 |
| 9301 | 9323 | CCATGTGATTTCACTTCCACTCC | 1821 | GGAGTGGAAGTGAAATCACA | 3590 |
| 9317 | 9339 | CCACTCCATAACGCTCCTCATAC | 1822 | GTATGAGGAGCGTTATGGAG | 3591 |
| 9322 | 9344 | CCATAACGCTCCTCATACTAGGC | 1823 | GCCTAGTATGAGGAGCGTTA | 3592 |
| 9332 | 9354 | CCTCATACTAGGCCTACTAACCA | 1824 | TGGTTAGTAGGCCTAGTATG | 3593 |
| 9344 | 9366 | CCTACTAACCAACACACTAACCA | 1825 | TGGTTAGTGTGTTGGTTAGT | 3594 |
| 9352 | 9374 | CCAACACACTAACCATATACCAA | 1826 | TTGGTATATGGTTAGTGTGT | 3595 |
| 9364 | 9386 | CCATATACCAATGATGGCGCGAT | 1827 | ATCGCGCCATCATTGGTATA | 3596 |
| 9371 | 9393 | CCAATGATGGCGCGATGTAACAC | 1828 | GTGTTACATCGCGCCATCAT | 3597 |
| 9407 | 9429 | CCAAGGCCACCACACACCACCTG | 1829 | CAGGTGGTGTGTGGTGGCCT | 3598 |
| 9413 | 9435 | CCACCACACACCACCTGTCCAAA | 1830 | TTTGGACAGGTGGTGTGTGG | 3599 |
| 9416 | 9438 | CCACACACCACCTGTCCAAAAAG | 1831 | CTTTTTGGACAGGTGGTGTG | 3600 |
| 9423 | 9445 | CCACCTGTCCAAAAAGGCCTTCG | 1832 | CGAAGGCCTTTTTGGACAGG | 3601 |
| 9426 | 9448 | CCTGTCCAAAAAGGCCTTCGATA | 1833 | TATCGAAGGCCTTTTTGGAC | 3602 |
| 9431 | 9453 | CCAAAAAGGCCTTCGATACGGGA | 1834 | TCCCGTATCGAAGGCCTTTT | 3603 |
| 9440 | 9462 | CCTTCGATACGGGATAATCCTAT | 1835 | ATAGGATTATCCCGTATCGA | 3604 |
| 9458 | 9480 | CCTATTTATTACCTCAGAAGTTT | 1836 | AAACTTCTGAGGTAATAAAT | 3605 |
| 9469 | 9491 | CCTCAGAAGTTTTTTTCTTCGCA | 1837 | TGCGAAGAAAAAACTTCTG | 3606 |
| 9505 | 9527 | CCTTTTACCACTCCAGCCTAGCC | 1838 | GGCTAGGCTGGAGTGGTAAA | 3607 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 9512 | 9534 | CCACTCCAGCCTAGCCCCTACCC | 1839 | GGGTAGGGGCTAGGCTGGAG | 3608 |
| 9517 | 9539 | CCAGCCTAGCCCCTACCCCCCAA | 1840 | TTGGGGGGTAGGGCTAGGC | 3609 |
| 9521 | 9543 | CCTAGCCCCTACCCCCCAATTAG | 1841 | CTAATTGGGGGTAGGGGCT | 3610 |
| 9526 | 9548 | CCCCTACCCCCCAATTAGGAGGG | 1842 | CCCTCCTAATTGGGGGTAG | 3611 |
| 9527 | 9549 | CCCTACCCCCCAATTAGGAGGGC | 1843 | GCCCTCCTAATTGGGGGGTA | 3612 |
| 9528 | 9550 | CCTACCCCCCAATTAGGAGGGCA | 1844 | TGCCCTCCTAATTGGGGGGT | 3613 |
| 9532 | 9554 | CCCCCCAATTAGGAGGGCACTGG | 1845 | CCAGTGCCCTCCTAATTGGG | 3614 |
| 9533 | 9555 | CCCCCAATTAGGAGGGCACTGGC | 1846 | GCCAGTGCCCTCCTAATTGG | 3615 |
| 9534 | 9556 | CCCCAATTAGGAGGGCACTGGCC | 1847 | GGCCAGTGCCCTCCTAATTG | 3616 |
| 9535 | 9557 | CCCAATTAGGAGGGCACTGGCCC | 1848 | GGGCCAGTGCCCTCCTAATT | 3617 |
| 9536 | 9558 | CCAATTAGGAGGGCACTGGCCCC | 1849 | GGGGCCAGTGCCCTCCTAAT | 3618 |
| 9555 | 9577 | CCCCCAACAGGCATCACCCCGCT | 1850 | AGCGGGGTGATGCCTGTTGG | 3619 |
| 9556 | 9578 | CCCCAACAGGCATCACCCCGCTA | 1851 | TAGCGGGGTGATGCCTGTTG | 3620 |
| 9557 | 9579 | CCCAACAGGCATCACCCCGCTAA | 1852 | TTAGCGGGGTGATGCCTGTT | 3621 |
| 9558 | 9580 | CCAACAGGCATCACCCCGCTAAA | 1853 | TTTAGCGGGGTGATGCCTGT | 3622 |
| 9571 | 9593 | CCCCGCTAAATCCCCTAGAAGTC | 1854 | GACTTCTAGGGGATTTAGCG | 3623 |
| 9572 | 9594 | CCCGCTAAATCCCCTAGAAGTCC | 1855 | GGACTTCTAGGGGATTTAGC | 3624 |
| 9573 | 9595 | CCGCTAAATCCCCTAGAAGTCCC | 1856 | GGGACTTCTAGGGGATTTAG | 3625 |
| 9582 | 9604 | CCCCTAGAAGTCCCACTCCTAAA | 1857 | TTTAGGAGTGGGACTTCTAG | 3626 |
| 9583 | 9605 | CCCTAGAAGTCCCACTCCTAAAC | 1858 | GTTTAGGAGTGGGACTTCTA | 3627 |
| 9584 | 9606 | CCTAGAAGTCCCACTCCTAAACA | 1859 | TGTTTAGGAGTGGGACTTCT | 3628 |
| 9593 | 9615 | CCCACTCCTAAACACATCCGTAT | 1860 | ATACGGATGTGTTTAGGAGT | 3629 |
| 9594 | 9616 | CCACTCCTAAACACATCCGTATT | 1861 | AATACGGATGTGTTTAGGAG | 3630 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 9599 | 9621 | CCTAAACACATCCGTATTACTCG | 1862 | CGAGTAATACGGATGTGTTT | 3631 |
| 9610 | 9632 | CCGTATTACTCGCATCAGGAGTA | 1863 | TACTCCTGATGCGAGTAATA | 3632 |
| 9640 | 9662 | CCTGAGCTCACCATAGTCTAATA | 1864 | TATTAGACTATGGTGAGCTC | 3633 |
| 9650 | 9672 | CCATAGTCTAATAGAAACAACC | 1865 | GGTTGTTTTCTATTAGACTA | 3634 |
| 9671 | 9693 | CCGAAACCAAATAATTCAAGCAC | 1866 | GTGCTTGAATTATTTGGTTT | 3635 |
| 9677 | 9699 | CCAAATAATTCAAGCACTGCTTA | 1867 | TAAGCAGTGCTTGAATTATT | 3636 |
| 9727 | 9749 | CCCTCCTACAAGCCTCAGAGTAC | 1868 | GTACTCTGAGGCTTGTAGGA | 3637 |
| 9728 | 9750 | CCTCCTACAAGCCTCAGAGTACT | 1869 | AGTACTCTGAGGCTTGTAGG | 3638 |
| 9731 | 9753 | CCTACAAGCCTCAGAGTACTTCG | 1870 | CGAAGTACTCTGAGGCTTGT | 3639 |
| 9739 | 9761 | CCTCAGAGTACTTCGAGTCTCCC | 1871 | GGGAGACTCGAAGTACTCTG | 3640 |
| 9759 | 9781 | CCCTTCACCATTTCCGACGGCAT | 1872 | ATGCCGTCGGAAATGGTGAA | 3641 |
| 9760 | 9782 | CCTTCACCATTTCCGACGGCATC | 1873 | GATGCCGTCGGAAATGGTGA | 3642 |
| 9766 | 9788 | CCATTTCCGACGGCATCTACGGC | 1874 | GCCGTAGATGCCGTCGGAAA | 3643 |
| 9772 | 9794 | CCGACGGCATCTACGGCTCAACA | 1875 | TGTTGAGCCGTAGATGCCGT | 3644 |
| 9805 | 9827 | CCACAGGCTTCCACGGACTTCAC | 1876 | GTGAAGTCCGTGGAAGCCTG | 3645 |
| 9815 | 9837 | CCACGGACTTCACGTCATTATTG | 1877 | CAATAATGACGTGAAGTCCG | 3646 |
| 9848 | 9870 | CCTCACTATCTGCTTCATCCGCC | 1878 | GGCGGATGAAGCAGATAGTG | 3647 |
| 9866 | 9888 | CCGCCAACTAATATTTCACTTTA | 1879 | TAAAGTGAAATATTAGTTGG | 3648 |
| 9869 | 9891 | CCAACTAATATTTCACTTTACAT | 1880 | ATGTAAAGTGAAATATTAGT | 3649 |
| 9892 | 9914 | CCAAACATCACTTTGGCTTCGAA | 1881 | TTCGAAGCCAAAGTGATGTT | 3650 |
| 9916 | 9938 | CCGCCGCTGATACTGGCATTTT | 1882 | AAAATGCCAGTATCAGGCGG | 3651 |
| 9919 | 9941 | CCGCCTGATACTGGCATTTTGTA | 1883 | TACAAAATGCCAGTATCAGG | 3652 |
| 9922 | 9944 | CCTGATACTGGCATTTTGTAGAT | 1884 | ATCTACAAAATGCCAGTATC | 3653 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 9970 | 9992 | CCATCTATTGATGAGGGTCTTAC | 1885 | GTAAGACCCTCATCAATAGA | 3654 |
| 10012 | 10034 | CCGTTAACTTCCAATTAACTAGT | 1886 | ACTAGTTAATTGGAAGTTAA | 3655 |
| 10022 | 10044 | CCAATTAACTAGTTTTGACAACA | 1887 | TGTTGTCAAAACTAGTTAAT | 3656 |
| 10069 | 10091 | CCTTAATTTTAATAATCAACACC | 1888 | GGTGTTGATTATTAAAATTA | 3657 |
| 10090 | 10112 | CCCTCCTAGCCTTACTACTAATA | 1889 | TATTAGTAGTAAGGCTAGGA | 3658 |
| 10091 | 10113 | CCTCCTAGCCTTACTACTAATAA | 1890 | TTATTAGTAGTAAGGCTAGG | 3659 |
| 10094 | 10116 | CCTAGCCTTACTACTAATAATTA | 1891 | TAATTATTAGTAGTAAGGCT | 3660 |
| 10099 | 10121 | CCTTACTACTAATAATTATTACA | 1892 | TGTAATAATTATTAGTAGTA | 3661 |
| 10131 | 10153 | CCACAACTCAACGGCTACATAGA | 1893 | TCTATGTAGCCGTTGAGTTG | 3662 |
| 10159 | 10181 | CCACCCCTTACGAGTGCGGCTTC | 1894 | GAAGCCGCACTCGTAAGGGG | 3663 |
| 10162 | 10184 | CCCCTTACGAGTGCGGCTTCGAC | 1895 | GTCGAAGCCGCACTCGTAAG | 3664 |
| 10163 | 10185 | CCCTTACGAGTGCGGCTTCGACC | 1896 | GGTCGAAGCCGCACTCGTAA | 3665 |
| 10164 | 10186 | CCTTACGAGTGCGGCTTCGACCC | 1897 | GGGTCGAAGCCGCACTCGTA | 3666 |
| 10184 | 10206 | CCCTATATCCCCCGCCCGCGTCC | 1898 | GGACGCGGGCGGGGATATA | 3667 |
| 10185 | 10207 | CCTATATCCCCCGCCCGCGTCCC | 1899 | GGGACGCGGGCGGGGATAT | 3668 |
| 10192 | 10214 | CCCCCGCCCGCGTCCCTTCTCC | 1900 | GGAGAAAGGGACGCGGGCGG | 3669 |
| 10193 | 10215 | CCCCGCCCGCGTCCCTTTCTCCA | 1901 | TGGAGAAAGGGACGCGGGCG | 3670 |
| 10194 | 10216 | CCCGCCCGCGTCCCTTTCTCCAT | 1902 | ATGGAGAAAGGGACGCGGGC | 3671 |
| 10195 | 10217 | CCGCCCGCGTCCCTTTCTCCATA | 1903 | TATGGAGAAAGGGACGCGGG | 3672 |
| 10198 | 10220 | CCCGCGTCCCTTTCTCCATAAAA | 1904 | TTTTATGGAGAAAGGGACGC | 3673 |
| 10199 | 10221 | CCGCGTCCCTTTCTCCATAAAAT | 1905 | ATTTTATGGAGAAAGGGACG | 3674 |
| 10205 | 10227 | CCCTTTCTCCATAAAATTCTTCT | 1906 | AGAAGAATTTTATGGAGAAA | 3675 |
| 10206 | 10228 | CCTTTCTCCATAAAATTCTTCTT | 1907 | AAGAAGAATTTTATGGAGAA | 3676 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 10213 | 10235 | CCATAAAATTCTTCTTAGTAGCT | 1908 | AGCTACTAAGAAGAATTTTA | 3677 |
| 10240 | 10262 | CCTTCTTATTATTTGATCTAGAA | 1909 | TTCTAGATCAAATAATAAGA | 3678 |
| 10267 | 10289 | CCCTCCTTTTACCCCTACCATGA | 1910 | TCATGGTAGGGGTAAAAGGA | 3679 |
| 10268 | 10290 | CCTCCTTTTACCCCTACCATGAG | 1911 | CTCATGGTAGGGGTAAAAGG | 3680 |
| 10271 | 10293 | CCTTTTACCCCTACCATGAGCCC | 1912 | GGGCTCATGGTAGGGGTAAA | 3681 |
| 10278 | 10300 | CCCCTACCATGAGCCCTACAAAC | 1913 | GTTTGTAGGGCTCATGGTAG | 3682 |
| 10279 | 10301 | CCCTACCATGAGCCCTACAAACA | 1914 | TGTTTGTAGGGCTCATGGTA | 3683 |
| 10280 | 10302 | CCTACCATGAGCCCTACAAACAA | 1915 | TTGTTTGTAGGGCTCATGGT | 3684 |
| 10284 | 10306 | CCATGAGCCCTACAAACAACTAA | 1916 | TTAGTTGTTTGTAGGGCTCA | 3685 |
| 10291 | 10313 | CCCTACAAACAACTAACCTGCCA | 1917 | TGGCAGGTTAGTTGTTTGTA | 3686 |
| 10292 | 10314 | CCTACAAACAACTAACCTGCCAC | 1918 | GTGGCAGGTTAGTTGTTTGT | 3687 |
| 10307 | 10329 | CCTGCCACTAATAGTTATGTCAT | 1919 | ATGACATAACTATTAGTGGC | 3688 |
| 10311 | 10333 | CCACTAATAGTTATGTCATCCCT | 1920 | AGGGATGACATAACTATTAG | 3689 |
| 10330 | 10352 | CCCTCTTATTAATCATCATCCTA | 1921 | TAGGATGATGATTAATAAGA | 3690 |
| 10331 | 10353 | CCTCTTATTAATCATCATCCTAG | 1922 | CTAGGATGATGATTAATAAG | 3691 |
| 10349 | 10371 | CCTAGCCCTAAGTCTGGCCTATG | 1923 | CATAGGCCAGACTTAGGGCT | 3692 |
| 10354 | 10376 | CCCTAAGTCTGGCCTATGAGTGA | 1924 | TCACTCATAGGCCAGACTTA | 3693 |
| 10355 | 10377 | CCTAAGTCTGGCCTATGAGTGAC | 1925 | GTCACTCATAGGCCAGACTT | 3694 |
| 10366 | 10388 | CCTATGAGTGACTACAAAAAGGA | 1926 | TCCTTTTTGTAGTCACTCAT | 3695 |
| 10399 | 10421 | CCGAATTGGTATATAGTTTAAAC | 1927 | GTTTAAACTATATACCAATT | 3696 |
| 10466 | 10488 | CCAAATGCCCCTCATTTACATAA | 1928 | TTATGTAAATGAGGGGCATT | 3697 |
| 10473 | 10495 | CCCCTCATTTACATAAATATTAT | 1929 | ATAATATTTATGTAAATGAG | 3698 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 10474 | 10496 | CCCTCATTTACATAAATATTATA | 1930 | TATAATATTTATGTAAATGA | 3699 |
| 10475 | 10497 | CCTCATTTACATAAATATTATAC | 1931 | GTATAATATTTATGTAAATG | 3700 |
| 10507 | 10529 | CCATCTCACTTCTAGGAATACTA | 1932 | TAGTATTCCTAGAAGTGAGA | 3701 |
| 10544 | 10566 | CCTCATATCCTCCCTACTATGCC | 1933 | GGCATAGTAGGGAGGATATG | 3702 |
| 10552 | 10574 | CCTCCCTACTATGCCTAGAAGGA | 1934 | TCCTTCTAGGCATAGTAGGG | 3703 |
| 10555 | 10577 | CCCTACTATGCCTAGAAGGAATA | 1935 | TATTCCTTCTAGGCATAGTA | 3704 |
| 10556 | 10578 | CCTACTATGCCTAGAAGGAATAA | 1936 | TTATTCCTTCTAGGCATAGT | 3705 |
| 10565 | 10587 | CCTAGAAGGAATAATACTATCGC | 1937 | GCGATAGTATTATTCCTTCT | 3706 |
| 10612 | 10634 | CCCTCAACACCCACTCCCTCTTA | 1938 | TAAGAGGGAGTGGGTGTTGA | 3707 |
| 10613 | 10635 | CCTCAACACCCACTCCCTCTTAG | 1939 | CTAAGAGGGAGTGGGTGTTG | 3708 |
| 10621 | 10643 | CCCACTCCCTCTTAGCCAATATT | 1940 | AATATTGGCTAAGAGGGAGT | 3709 |
| 10622 | 10644 | CCACTCCCTCTTAGCCAATATTG | 1941 | CAATATTGGCTAAGAGGGAG | 3710 |
| 10627 | 10649 | CCCTCTTAGCCAATATTGTGCCT | 1942 | AGGCACAATATTGGCTAAGA | 3711 |
| 10628 | 10650 | CCTCTTAGCCAATATTGTGCCTA | 1943 | TAGGCACAATATTGGCTAAG | 3712 |
| 10636 | 10658 | CCAATATTGTGCCTATTGCCATA | 1944 | TATGGCAATAGGCACAATAT | 3713 |
| 10647 | 10669 | CCTATTGCCATACTAGTCTTTGC | 1945 | GCAAAGACTAGTATGGCAAT | 3714 |
| 10654 | 10676 | CCATACTAGTCTTTGCCGCTGC | 1946 | GCAGGCGGCAAAGACTAGTA | 3715 |
| 10669 | 10691 | CCGCCTGCGAAGCAGCGGTGGGC | 1947 | GCCCACCGCTGCTTCGCAGG | 3716 |
| 10672 | 10694 | CCTGCGAAGCAGCGGTGGGCCTA | 1948 | TAGGCCCACCGCTGCTTCGC | 3717 |
| 10691 | 10713 | CCTAGCCCTACTAGTCTCAATCT | 1949 | AGATTGAGACTAGTAGGGCT | 3718 |
| 10696 | 10718 | CCCTACTAGTCTCAATCTCCAAC | 1950 | GTTGGAGATTGAGACTAGTA | 3719 |
| 10697 | 10719 | CCTACTAGTCTCAATCTCCAACA | 1951 | TGTTGGAGATTGAGACTAGT | 3720 |
| 10714 | 10736 | CCAACACATATGGCCTAGACTAC | 1952 | GTAGTCTAGGCCATATGTGT | 3721 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 10727 | 10749 | CCTAGACTACGTACATAACCTAA | 1953 | TTAGGTTATGTACGTAGTCT | 3722 |
| 10745 | 10767 | CCTAAACCTACTCCAATGCTAAA | 1954 | TTTAGCATTGGAGTAGGTTT | 3723 |
| 10751 | 10773 | CCTACTCCAATGCTAAAACTAAT | 1955 | ATTAGTTTTAGCATTGGAGT | 3724 |
| 10757 | 10779 | CCAATGCTAAAACTAATCGTCCC | 1956 | GGGACGATTAGTTTTAGCAT | 3725 |
| 10777 | 10799 | CCCAACAATTATATTACTACCAC | 1957 | GTGGTAGTAATATAATTGTT | 3726 |
| 10778 | 10800 | CCAACAATTATATTACTACCACT | 1958 | AGTGGTAGTAATATAATTGT | 3727 |
| 10796 | 10818 | CCACTGACATGACTTTCCAAAAA | 1959 | TTTTTGGAAAGTCATGTCAG | 3728 |
| 10812 | 10834 | CCAAAAAACACATAATTTGAATC | 1960 | GATTCAAATTATGTGTTTTT | 3729 |
| 10842 | 10864 | CCACCCACAGCCTAATTATTAGC | 1961 | GCTAATAATTAGGCTGTGGG | 3730 |
| 10845 | 10867 | CCCACAGCCTAATTATTAGCATC | 1962 | GATGCTAATAATTAGGCTGT | 3731 |
| 10846 | 10868 | CCACAGCCTAATTATTAGCATCA | 1963 | TGATGCTAATAATTAGGCTG | 3732 |
| 10852 | 10874 | CCTAATTATTAGCATCATCCCTC | 1964 | GAGGGATGATGCTAATAATT | 3733 |
| 10870 | 10892 | CCCTCTACTATTTTTAACCAAA | 1965 | TTTGGTTAAAAAATAGTAGA | 3734 |
| 10871 | 10893 | CCTCTACTATTTTTAACCAAAT | 1966 | ATTTGGTTAAAAAATAGTAG | 3735 |
| 10888 | 10910 | CCAAATCAACAACAACCTATTTA | 1967 | TAAATAGGTTGTTGTTGATT | 3736 |
| 10903 | 10925 | CCTATTTAGCTGTTCCCCAACCT | 1968 | AGGTTGGGGAACAGCTAAAT | 3737 |
| 10917 | 10939 | CCCCAACCTTTTCCTCCGACCCC | 1969 | GGGGTCGGAGGAAAAGGTTG | 3738 |
| 10918 | 10940 | CCCAACCTTTTCCTCCGACCCCC | 1970 | GGGGGTCGGAGGAAAAGGTT | 3739 |
| 10919 | 10941 | CCAACCTTTTCCTCCGACCCCCT | 1971 | AGGGGGTCGGAGGAAAAGGT | 3740 |
| 10923 | 10945 | CCTTTTCCTCCGACCCCCTAACA | 1972 | TGTTAGGGGGTCGGAGGAAA | 3741 |
| 10929 | 10951 | CCTCCGACCCCCTAACAACCCCC | 1973 | GGGGGTTGTTAGGGGGTCGG | 3742 |
| 10932 | 10954 | CCGACCCCCTAACAACCCCCTC | 1974 | GAGGGGGGTTGTTAGGGGGT | 3743 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 10936 | 10958 | CCCCCTAACAACCCCCCTCCTAA | 1975 | TTAGGAGGGGGGTTGTTAGG | 3744 |
| 10937 | 10959 | CCCCTAACAACCCCCCTCCTAAT | 1976 | ATTAGGAGGGGGGTTGTTAG | 3745 |
| 10938 | 10960 | CCCTAACAACCCCCCTCCTAATA | 1977 | TATTAGGAGGGGGGTTGTTA | 3746 |
| 10939 | 10961 | CCTAACAACCCCCCTCCTAATAC | 1978 | GTATTAGGAGGGGGGTTGTT | 3747 |
| 10947 | 10969 | CCCCCCTCCTAATACTAACTACC | 1979 | GGTAGTTAGTATTAGGAGGG | 3748 |
| 10948 | 10970 | CCCCCTCCTAATACTAACTACCT | 1980 | AGGTAGTTAGTATTAGGAGG | 3749 |
| 10949 | 10971 | CCCCTCCTAATACTAACTACCTG | 1981 | CAGGTAGTTAGTATTAGGAG | 3750 |
| 10950 | 10972 | CCCTCCTAATACTAACTACCTGA | 1982 | TCAGGTAGTTAGTATTAGGA | 3751 |
| 10951 | 10973 | CCTCCTAATACTAACTACCTGAC | 1983 | GTCAGGTAGTTAGTATTAGG | 3752 |
| 10954 | 10976 | CCTAATACTAACTACCTGACTCC | 1984 | GGAGTCAGGTAGTTAGTATT | 3753 |
| 10968 | 10990 | CCTGACTCCTACCCCTCACAATC | 1985 | GATTGTGAGGGGTAGGAGTC | 3754 |
| 10975 | 10997 | CCTACCCCTCACAATCATGGCAA | 1986 | TTGCCATGATTGTGAGGGGT | 3755 |
| 10979 | 11001 | CCCCTCACAATCATGGCAAGCCA | 1987 | TGGCTTGCCATGATTGTGAG | 3756 |
| 10980 | 11002 | CCCTCACAATCATGGCAAGCCAA | 1988 | TTGGCTTGCCATGATTGTGA | 3757 |
| 10981 | 11003 | CCTCACAATCATGGCAAGCCAAC | 1989 | GTTGGCTTGCCATGATTGTG | 3758 |
| 10999 | 11021 | CCAACGCCACTTATCCAGTGAAC | 1990 | GTTCACTGGATAAGTGGCGT | 3759 |
| 11005 | 11027 | CCACTTATCCAGTGAACCACTAT | 1991 | ATAGTGGTTCACTGGATAAG | 3760 |
| 11013 | 11035 | CCAGTGAACCACTATCACGAAAA | 1992 | TTTTCGTGATAGTGGTTCAC | 3761 |
| 11021 | 11043 | CCACTATCACGAAAAAAACTCTA | 1993 | TAGAGTTTTTTTCGTGATAG | 3762 |
| 11044 | 11066 | CCTCTCTATACTAATCTCCCTAC | 1994 | GTAGGGAGATTAGTATAGAG | 3763 |
| 11061 | 11083 | CCCTACAAATCTCCTTAATTATA | 1995 | TATAATTAAGGAGATTTGTA | 3764 |
| 11062 | 11084 | CCTACAAATCTCCTTAATTATAA | 1996 | TTATAATTAAGGAGATTTGT | 3765 |
| 11073 | 11095 | CCTTAATTATAACATTCACAGCC | 1997 | GGCTGTGAATGTTATAATTA | 3766 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 11094 | 11116 | CCACAGAACTAATCATATTTTAT | 1998 | ATAAAATATGATTAGTTCTG | 3767 |
| 11130 | 11152 | CCACACTTATCCCCACCTTGGCT | 1999 | AGCCAAGGTGGGGATAAGTG | 3768 |
| 11140 | 11162 | CCCCACCTTGGCTATCATCACCC | 2000 | GGGTGATGATAGCCAAGGTG | 3769 |
| 11141 | 11163 | CCCACCTTGGCTATCATCACCCG | 2001 | CGGGTGATGATAGCCAAGGT | 3770 |
| 11142 | 11164 | CCACCTTGGCTATCATCACCCGA | 2002 | TCGGGTGATGATAGCCAAGG | 3771 |
| 11145 | 11167 | CCTTGGCTATCATCACCCGATGA | 2003 | TCATCGGGTGATGATAGCCA | 3772 |
| 11160 | 11182 | CCCGATGAGGCAACCAGCCAGAA | 2004 | TTCTGGCTGGTTGCCTCATC | 3773 |
| 11161 | 11183 | CCGATGAGGCAACCAGCCAGAAC | 2005 | GTTCTGGCTGGTTGCCTCAT | 3774 |
| 11173 | 11195 | CCAGCCAGAACGCCTGAACGCAG | 2006 | CTGCGTTCAGGCGTTCTGGC | 3775 |
| 11177 | 11199 | CCAGAACGCCTGAACGCAGGCAC | 2007 | GTGCCTGCGTTCAGGCGTTC | 3776 |
| 11185 | 11207 | CCTGAACGCAGGCACATACTTCC | 2008 | GGAAGTATGTGCCTGCGTTC | 3777 |
| 11206 | 11228 | CCTATTCTACACCCTAGTAGGCT | 2009 | AGCCTACTAGGGTGTAGAAT | 3778 |
| 11217 | 11239 | CCCTAGTAGGCTCCCTTCCCCTA | 2010 | TAGGGGAAGGGAGCCTACTA | 3779 |
| 11218 | 11240 | CCTAGTAGGCTCCCTTCCCTAC | 2011 | GTAGGGGAAGGGAGCCTACT | 3780 |
| 11229 | 11251 | CCCTTCCCCTACTCATCGCACTA | 2012 | TAGTGCGATGAGTAGGGGAA | 3781 |
| 11230 | 11252 | CCTTCCCCTACTCATCGCACTAA | 2013 | TTAGTGCGATGAGTAGGGGA | 3782 |
| 11234 | 11256 | CCCCTACTCATCGCACTAATTTA | 2014 | TAAATTAGTGCGATGAGTAG | 3783 |
| 11235 | 11257 | CCCTACTCATCGCACTAATTTAC | 2015 | GTAAATTAGTGCGATGAGTA | 3784 |
| 11236 | 11258 | CCTACTCATCGCACTAATTTACA | 2016 | TGTAAATTAGTGCGATGAGT | 3785 |
| 11268 | 11290 | CCCTAGGCTCACTAAACATTCTA | 2017 | TAGAATGTTTAGTGAGCCTA | 3786 |
| 11269 | 11291 | CCTAGGCTCACTAAACATTCTAC | 2018 | GTAGAATGTTTAGTGAGCCT | 3787 |
| 11307 | 11329 | CCCAAGAACTATCAAACTCCTGA | 2019 | TCAGGAGTTTGATAGTTCTT | 3788 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 11308 | 11330 | CCAAGAACTATCAAACTCCTGAG | 2020 | CTCAGGAGTTTGATAGTTCT | 3789 |
| 11325 | 11347 | CCTGAGCCAACAACTTAATATGA | 2021 | TCATATTAAGTTGTTGGCTC | 3790 |
| 11331 | 11353 | CCAACAACTTAATATGACTAGCT | 2022 | AGCTAGTCATATTAAGTTGT | 3791 |
| 11381 | 11403 | CCTCTTTACGGACTCCACTTATG | 2023 | CATAAGTGGAGTCCGTAAAG | 3792 |
| 11395 | 11417 | CCACTTATGACTCCCTAAAGCCC | 2024 | GGGCTTTAGGGAGTCATAAG | 3793 |
| 11407 | 11429 | CCCTAAAGCCCATGTCGAAGCCC | 2025 | GGGCTTCGACATGGGCTTTA | 3794 |
| 11408 | 11430 | CCTAAAGCCCATGTCGAAGCCCC | 2026 | GGGGCTTCGACATGGGCTTT | 3795 |
| 11415 | 11437 | CCCATGTCGAAGCCCCCATCGCT | 2027 | AGCGATGGGGGCTTCGACAT | 3796 |
| 11416 | 11438 | CCATGTCGAAGCCCCCATCGCTG | 2028 | CAGCGATGGGGGCTTCGACA | 3797 |
| 11427 | 11449 | CCCCCATCGCTGGGTCAATAGTA | 2029 | TACTATTGACCCAGCGATGG | 3798 |
| 11428 | 11450 | CCCCATCGCTGGGTCAATAGTAC | 2030 | GTACTATTGACCCAGCGATG | 3799 |
| 11429 | 11451 | CCCATCGCTGGGTCAATAGTACT | 2031 | AGTACTATTGACCCAGCGAT | 3800 |
| 11430 | 11452 | CCATCGCTGGGTCAATAGTACTT | 2032 | AAGTACTATTGACCCAGCGA | 3801 |
| 11454 | 11476 | CCGCAGTACTCTTAAAACTAGGC | 2033 | GCCTAGTTTTAAGAGTACTG | 3802 |
| 11494 | 11516 | CCTCACACTCATTCTCAACCCCC | 2034 | GGGGGTTGAGAATGAGTGTG | 3803 |
| 11512 | 11534 | CCCCCTGACAAAACACATAGCCT | 2035 | AGGCTATGTGTTTTGTCAGG | 3804 |
| 11513 | 11535 | CCCCTGACAAAACACATAGCCTA | 2036 | TAGGCTATGTGTTTTGTCAG | 3805 |
| 11514 | 11536 | CCCTGACAAAACACATAGCCTAC | 2037 | GTAGGCTATGTGTTTTGTCA | 3806 |
| 11515 | 11537 | CCTGACAAAACACATAGCCTACC | 2038 | GGTAGGCTATGTGTTTTGTC | 3807 |
| 11532 | 11554 | CCTACCCCTTCCTTGTACTATCC | 2039 | GGATAGTACAAGGAAGGGGT | 3808 |
| 11536 | 11558 | CCCCTTCCTTGTACTATCCCTAT | 2040 | ATAGGGATAGTACAAGGAAG | 3809 |
| 11537 | 11559 | CCCTTCCTTGTACTATCCCTATG | 2041 | CATAGGGATAGTACAAGGAA | 3810 |
| 11538 | 11560 | CCTTCCTTGTACTATCCCTATGA | 2042 | TCATAGGGATAGTACAAGGA | 3811 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 11542 | 11564 | CCTTGTACTATCCCTATGAGGCA | 2043 | TGCCTCATAGGGATAGTACA | 3812 |
| 11553 | 11575 | CCCTATGAGGCATAATTATAACA | 2044 | TGTTATAATTATGCCTCATA | 3813 |
| 11554 | 11576 | CCTATGAGGCATAATTATAACAA | 2045 | TTGTTATAATTATGCCTCAT | 3814 |
| 11580 | 11602 | CCATCTGCCTACGACAAACAGAC | 2046 | GTCTGTTTGTCGTAGGCAGA | 3815 |
| 11587 | 11609 | CCTACGACAAACAGACCTAAAAT | 2047 | ATTTTAGGTCTGTTTGTCGT | 3816 |
| 11602 | 11624 | CCTAAAATCGCTCATTGCATACT | 2048 | AGTATGCAATGAGCGATTTT | 3817 |
| 11635 | 11657 | CCACATAGCCCTCGTAGTAACAG | 2049 | CTGTTACTACGAGGGCTATG | 3818 |
| 11643 | 11665 | CCCTCGTAGTAACAGCCATTCTC | 2050 | GAGAATGGCTGTTACTACGA | 3819 |
| 11644 | 11666 | CCTCGTAGTAACAGCCATTCTCA | 2051 | TGAGAATGGCTGTTACTACG | 3820 |
| 11658 | 11680 | CCATTCTCATCCAAACCCCTGA | 2052 | TCAGGGGTTTGGATGAGAA | 3821 |
| 11668 | 11690 | CCAAACCCCTGAAGCTTCACCG | 2053 | CGGTGAAGCTTCAGGGGGTT | 3822 |
| 11673 | 11695 | CCCCCTGAAGCTTCACCGGCGCA | 2054 | TGCGCCGGTGAAGCTTCAGG | 3823 |
| 11674 | 11696 | CCCCTGAAGCTTCACCGGCGCAG | 2055 | CTGCGCCGGTGAAGCTTCAG | 3824 |
| 11675 | 11697 | CCCTGAAGCTTCACCGGCGCAGT | 2056 | ACTGCGCCGGTGAAGCTTCA | 3825 |
| 11676 | 11698 | CCTGAAGCTTCACCGGCGCAGTC | 2057 | GACTGCGCCGGTGAAGCTTC | 3826 |
| 11688 | 11710 | CCGGCGCAGTCATTCTCATAATC | 2058 | GATTATGAGAATGACTGCGC | 3827 |
| 11712 | 11734 | CCCACGGGCTTACATCCTCATTA | 2059 | TAATGAGGATGTAAGCCCGT | 3828 |
| 11713 | 11735 | CCACGGGCTTACATCCTCATTAC | 2060 | GTAATGAGGATGTAAGCCCG | 3829 |
| 11727 | 11749 | CCTCATTACTATTCTGCCTAGCA | 2061 | TGCTAGGCAGAATAGTAATG | 3830 |
| 11743 | 11765 | CCTAGCAAACTCAAACTACGAAC | 2062 | GTTCGTAGTTTGAGTTTGCT | 3831 |
| 11788 | 11810 | CCTCTCTCAAGGACTTCAAACTC | 2063 | GAGTTTGAAGTCCTTGAGAG | 3832 |
| 11815 | 11837 | CCCACTAATAGCTTTTTGATGAC | 2064 | GTCATCAAAAGCTATTAGT | 3833 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 11816 | 11838 | CCACTAATAGCTTTTGATGACT | 2065 | AGTCATCAAAAAGCTATTAG | 3834 |
| 11848 | 11870 | CCTCGCTAACCTCGCCTTACCCC | 2066 | GGGGTAAGGCGAGGTTAGCG | 3835 |
| 11857 | 11879 | CCTCGCCTTACCCCCACTATTA | 2067 | TAATAGTGGGGGTAAGGCG | 3836 |
| 11862 | 11884 | CCTTACCCCCACTATTAACCTA | 2068 | TAGGTTAATAGTGGGGGTA | 3837 |
| 11867 | 11889 | CCCCCACTATTAACCTACTGGG | 2069 | CCCAGTAGGTTAATAGTGGG | 3838 |
| 11868 | 11890 | CCCCACTATTAACCTACTGGGA | 2070 | TCCCAGTAGGTTAATAGTGG | 3839 |
| 11869 | 11891 | CCCCACTATTAACCTACTGGGAG | 2071 | CTCCCAGTAGGTTAATAGTG | 3840 |
| 11870 | 11892 | CCCACTATTAACCTACTGGGAGA | 2072 | TCTCCCAGTAGGTTAATAGT | 3841 |
| 11871 | 11893 | CCACTATTAACCTACTGGGAGAA | 2073 | TTCTCCCAGTAGGTTAATAG | 3842 |
| 11881 | 11903 | CCTACTGGGAGAACTCTCTGTGC | 2074 | GCACAGAGAGTTCTCCCAGT | 3843 |
| 11910 | 11932 | CCACGTTCTCCTGATCAAATATC | 2075 | GATATTTGATCAGGAGAACG | 3844 |
| 11919 | 11941 | CCTGATCAAATATCACTCTCCTA | 2076 | TAGGAGAGTGATATTTGATC | 3845 |
| 11938 | 11960 | CCTACTTACAGGACTCAACATAC | 2077 | GTATGTTGAGTCCTGTAAGT | 3846 |
| 11970 | 11992 | CCCTATACTCCCTCTACATATTT | 2078 | AAATATGTAGAGGGAGTATA | 3847 |
| 11971 | 11993 | CCTATACTCCCTCTACATATTTA | 2079 | TAAATATGTAGAGGGAGTAT | 3848 |
| 11979 | 12001 | CCCTCTACATATTTACCACAACA | 2080 | TGTTGTGGTAAATATGTAGA | 3849 |
| 11980 | 12002 | CCTCTACATATTTACCACAACAC | 2081 | GTGTTGTGGTAAATATGTAG | 3850 |
| 11994 | 12016 | CCACAACACAATGGGCTCACTC | 2082 | GAGTGAGCCCCATTGTGTTG | 3851 |
| 12018 | 12040 | CCCACCACATTAACAACATAAAA | 2083 | TTTTATGTTGTTAATGTGGT | 3852 |
| 12019 | 12041 | CCACCACATTAACAACATAAAAC | 2084 | GTTTTATGTTGTTAATGTGG | 3853 |
| 12022 | 12044 | CCACATTAACAACATAAACCCT | 2085 | AGGGTTTTATGTTGTTAATG | 3854 |
| 12041 | 12063 | CCCTCATTCACACGAGAAAACAC | 2086 | GTGTTTTCTCGTGTGAATGA | 3855 |
| 12042 | 12064 | CCTCATTCACACGAGAAAACACC | 2087 | GGTGTTTTCTCGTGTGAATG | 3856 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 12063 | 12085 | CCCTCATGTTCATACACCTATCC | 2088 | GGATAGGTGTATGAACATGA | 3857 |
| 12064 | 12086 | CCTCATGTTCATACACCTATCCC | 2089 | GGGATAGGTGTATGAACATG | 3858 |
| 12079 | 12101 | CCTATCCCCCATTCTCCTCCTAT | 2090 | ATAGGAGGAGAATGGGGGAT | 3859 |
| 12084 | 12106 | CCCCCATTCTCCTCCTATCCCTC | 2091 | GAGGGATAGGAGGAGAATGG | 3860 |
| 12085 | 12107 | CCCCATTCTCCTCCTATCCCTCA | 2092 | TGAGGGATAGGAGGAGAATG | 3861 |
| 12086 | 12108 | CCCATTCTCCTCCTATCCCTCAA | 2093 | TTGAGGGATAGGAGGAGAAT | 3862 |
| 12087 | 12109 | CCATTCTCCTCCTATCCCTCAAC | 2094 | GTTGAGGGATAGGAGGAGAA | 3863 |
| 12094 | 12116 | CCTCCTATCCCTCAACCCCGACA | 2095 | TGTCGGGGTTGAGGGATAGG | 3864 |
| 12097 | 12119 | CCTATCCCTCAACCCCGACATCA | 2096 | TGATGTCGGGGTTGAGGGAT | 3865 |
| 12102 | 12124 | CCCTCAACCCCGACATCATTACC | 2097 | GGTAATGATGTCGGGGTTGA | 3866 |
| 12103 | 12125 | CCTCAACCCCGACATCATTACCG | 2098 | CGGTAATGATGTCGGGGTTG | 3867 |
| 12109 | 12131 | CCCCGACATCATTACCGGGTTTT | 2099 | AAAACCCGGTAATGATGTCG | 3868 |
| 12110 | 12132 | CCCGACATCATTACCGGGTTTTC | 2100 | GAAAACCCGGTAATGATGTC | 3869 |
| 12111 | 12133 | CCGACATCATTACCGGGTTTTCC | 2101 | GGAAAACCCGGTAATGATGT | 3870 |
| 12123 | 12145 | CCGGGTTTTCCTCTTGTAAATAT | 2102 | ATATTTACAAGAGGAAAACC | 3871 |
| 12132 | 12154 | CCTCTTGTAAATATAGTTTAACC | 2103 | GGTTAAACTATATTTACAAG | 3872 |
| 12153 | 12175 | CCAAAACATCAGATTGTGAATCT | 2104 | AGATTCACAATCTGATGTTT | 3873 |
| 12194 | 12216 | CCCCTTATTTACCGAGAAAGCTC | 2105 | GAGCTTTCTCGGTAAATAAG | 3874 |
| 12195 | 12217 | CCCTTATTTACCGAGAAAGCTCA | 2106 | TGAGCTTTCTCGGTAAATAA | 3875 |
| 12196 | 12218 | CCTTATTTACCGAGAAAGCTCAC | 2107 | GTGAGCTTTCTCGGTAAATA | 3876 |
| 12205 | 12227 | CCGAGAAAGCTCACAAGAACTGC | 2108 | GCAGTTCTTGTGAGCTTTCT | 3877 |
| 12237 | 12259 | CCCCCATGTCTAACAACATGGCT | 2109 | AGCCATGTTGTTAGACATGG | 3878 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 12238 | 12260 | CCCCATGTCTAACAACATGGCTT | 2110 | AAGCCATGTTGTTAGACATG | 3879 |
| 12239 | 12261 | CCCATGTCTAACAACATGGCTTT | 2111 | AAAGCCATGTTGTTAGACAT | 3880 |
| 12240 | 12262 | CCATGTCTAACAACATGGCTTTC | 2112 | GAAAGCCATGTTGTTAGACA | 3881 |
| 12288 | 12310 | CCATTGGTCTTAGGCCCCAAAAA | 2113 | TTTTTGGGGCCTAAGACCAA | 3882 |
| 12302 | 12324 | CCCCAAAAATTTTGGTGCAACTC | 2114 | GAGTTGCACCAAAATTTTTG | 3883 |
| 12303 | 12325 | CCCAAAAATTTTGGTGCAACTCC | 2115 | GGAGTTGCACCAAAATTTTT | 3884 |
| 12304 | 12326 | CCAAAAATTTTGGTGCAACTCCA | 2116 | TGGAGTTGCACCAAAATTTT | 3885 |
| 12324 | 12346 | CCAAATAAAGTAATAACCATGC | 2117 | GCATGGTTATTACTTTTATT | 3886 |
| 12341 | 12363 | CCATGCACACTACTATAACCACC | 2118 | GGTGGTTATAGTAGTGTGCA | 3887 |
| 12359 | 12381 | CCACCCTAACCCTGACTTCCCTA | 2119 | TAGGGAAGTCAGGGTTAGGG | 3888 |
| 12362 | 12384 | CCCTAACCCTGACTTCCCTAATT | 2120 | AATTAGGGAAGTCAGGGTTA | 3889 |
| 12363 | 12385 | CCTAACCCTGACTTCCCTAATTC | 2121 | GAATTAGGGAAGTCAGGGTT | 3890 |
| 12368 | 12390 | CCCTGACTTCCCTAATTCCCCCC | 2122 | GGGGGGAATTAGGGAAGTCA | 3891 |
| 12369 | 12391 | CCTGACTTCCCTAATTCCCCCA | 2123 | TGGGGGGAATTAGGGAAGTC | 3892 |
| 12377 | 12399 | CCCTAATTCCCCCCATCCTTACC | 2124 | GGTAAGGATGGGGGGAATTA | 3893 |
| 12378 | 12400 | CCTAATTCCCCCCATCCTTACCA | 2125 | TGGTAAGGATGGGGGGAATT | 3894 |
| 12385 | 12407 | CCCCCCATCCTTACCACCCTCGT | 2126 | ACGAGGGTGGTAAGGATGGG | 3895 |
| 12386 | 12408 | CCCCCATCCTTACCACCCTCGTT | 2127 | AACGAGGGTGGTAAGGATGG | 3896 |
| 12387 | 12409 | CCCCATCCTTACCACCCTCGTTA | 2128 | TAACGAGGGTGGTAAGGATG | 3897 |
| 12388 | 12410 | CCCATCCTTACCACCCTCGTTAA | 2129 | TTAACGAGGGTGGTAAGGAT | 3898 |
| 12389 | 12411 | CCATCCTTACCACCCTCGTTAAC | 2130 | GTTAACGAGGGTGGTAAGGA | 3899 |
| 12393 | 12415 | CCTTACCACCCTCGTTAACCCTA | 2131 | TAGGGTTAACGAGGGTGGTA | 3900 |
| 12398 | 12420 | CCACCCTCGTTAACCCTAACAAA | 2132 | TTTGTTAGGGTTAACGAGGG | 3901 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 12401 | 12423 | CCCTCGTTAACCCTAACAAAAAA | 2133 | TTTTTTGTTAGGGTTAACGA | 3902 |
| 12402 | 12424 | CCTCGTTAACCCTAACAAAAAA | 2134 | TTTTTTTGTTAGGGTTAACG | 3903 |
| 12411 | 12433 | CCCTAACAAAAAAACTCATACC | 2135 | GGTATGAGTTTTTTTGTTA | 3904 |
| 12412 | 12434 | CCTAACAAAAAAACTCATACCC | 2136 | GGGTATGAGTTTTTTTGTT | 3905 |
| 12432 | 12454 | CCCCCATTATGTAAAATCCATTG | 2137 | CAATGGATTTTACATAATGG | 3906 |
| 12433 | 12455 | CCCCATTATGTAAAATCCATTGT | 2138 | ACAATGGATTTTACATAATG | 3907 |
| 12434 | 12456 | CCCATTATGTAAAATCCATTGTC | 2139 | GACAATGGATTTTACATAAT | 3908 |
| 12435 | 12457 | CCATTATGTAAAATCCATTGTCG | 2140 | CGACAATGGATTTTACATAA | 3909 |
| 12449 | 12471 | CCATTGTCGCATCCACCTTTATT | 2141 | AATAAAGGTGGATGCGACAA | 3910 |
| 12461 | 12483 | CCACCTTTATTATCAGTCTCTTC | 2142 | GAAGAGACTGATAATAAAGG | 3911 |
| 12464 | 12486 | CCTTTATTATCAGTCTCTTCCCC | 2143 | GGGGAAGAGACTGATAATAA | 3912 |
| 12483 | 12505 | CCCCACAACAATATTCATGTGCC | 2144 | GGCACATGAATATTGTTGTG | 3913 |
| 12484 | 12506 | CCCACAACAATATTCATGTGCCT | 2145 | AGGCACATGAATATTGTTGT | 3914 |
| 12485 | 12507 | CCACAACAATATTCATGTGCCTA | 2146 | TAGGCACATGAATATTGTTG | 3915 |
| 12504 | 12526 | CCTAGACCAAGAAGTTATTATCT | 2147 | AGATAATAACTTCTTGGTCT | 3916 |
| 12510 | 12532 | CCAAGAAGTTATTATCTCGAACT | 2148 | AGTTCGAGATAATAACTTCT | 3917 |
| 12542 | 12564 | CCACAACCCAAACAACCCAGCTC | 2149 | GAGCTGGGTTGTTTGGGTTG | 3918 |
| 12548 | 12570 | CCCAAACAACCCAGCTCTCCCTA | 2150 | TAGGGAGAGCTGGGTTGTTT | 3919 |
| 12549 | 12571 | CCAAACAACCCAGCTCTCCCTAA | 2151 | TTAGGGAGAGCTGGGTTGTT | 3920 |
| 12557 | 12579 | CCCAGCTCTCCCTAAGCTTCAAA | 2152 | TTTGAAGCTTAGGGAGAGCT | 3921 |
| 12558 | 12580 | CCAGCTCTCCCTAAGCTTCAAAC | 2153 | GTTTGAAGCTTAGGGAGAGC | 3922 |
| 12566 | 12588 | CCCTAAGCTTCAAACTAGACTAC | 2154 | GTAGTCTAGTTTGAAGCTTA | 3923 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 12567 | 12589 | CCTAAGCTTCAAACTAGACTACT | 2155 | AGTAGTCTAGTTTGAAGCTT | 3924 |
| 12593 | 12615 | CCATAATATTCATCCCTGTAGCA | 2156 | TGCTACAGGGATGAATATTA | 3925 |
| 12606 | 12628 | CCCTGTAGCATTGTTCGTTACAT | 2157 | ATGTAACGAACAATGCTACA | 3926 |
| 12607 | 12629 | CCTGTAGCATTGTTCGTTACATG | 2158 | CATGTAACGAACAATGCTAC | 3927 |
| 12632 | 12654 | CCATCATAGAATTCTCACTGTGA | 2159 | TCACAGTGAGAATTCTATGA | 3928 |
| 12669 | 12691 | CCCAAACATTAATCAGTTCTTCA | 2160 | TGAAGAACTGATTAATGTTT | 3929 |
| 12670 | 12692 | CCAAACATTAATCAGTTCTTCAA | 2161 | TTGAAGAACTGATTAATGTT | 3930 |
| 12708 | 12730 | CCTAATTACCATACTAATCTTAG | 2162 | CTAAGATTAGTATGGTAATT | 3931 |
| 12716 | 12738 | CCATACTAATCTTAGTTACCGCT | 2163 | AGCGGTAACTAAGATTAGTA | 3932 |
| 12734 | 12756 | CCGCTAACAACCTATTCAACTG | 2164 | CAGTTGGAATAGGTTGTTAG | 3933 |
| 12744 | 12766 | CCTATTCCAACTGTTCATCGGCT | 2165 | AGCCGATGAACAGTTGGAAT | 3934 |
| 12750 | 12772 | CCAACTGTTCATCGGCTGAGAGG | 2166 | CCTCTCAGCCGATGAACAGT | 3935 |
| 12788 | 12810 | CCTTCTTGCTCATCAGTTGATGA | 2167 | TCATCAACTGATGAGCAAGA | 3936 |
| 12815 | 12837 | CCCGAGCAGATGCCAACACAGCA | 2168 | TGCTGTGTTGGCATCTGCTC | 3937 |
| 12816 | 12838 | CCGAGCAGATGCCAACACAGCAG | 2169 | CTGCTGTGTTGGCATCTGCT | 3938 |
| 12827 | 12849 | CCAACACAGCAGCCATTCAAGCA | 2170 | TGCTTGAATGGCTGCTGTGT | 3939 |
| 12839 | 12861 | CCATTCAAGCAATCCTATACAAC | 2171 | GTTGTATAGGATTGCTTGAA | 3940 |
| 12852 | 12874 | CCTATACAACCGTATCGGCGATA | 2172 | TATCGCCGATACGGTTGTAT | 3941 |
| 12861 | 12883 | CCGTATCGGCGATATCGGTTTCA | 2173 | TGAAACCGATATCGCCGATA | 3942 |
| 12885 | 12907 | CCTCGCCTTAGCATGATTTATCC | 2174 | GGATAAATCATGCTAAGGCG | 3943 |
| 12890 | 12912 | CCTTAGCATGATTTATCCTACAC | 2175 | GTGTAGGATAAATCATGCTA | 3944 |
| 12906 | 12928 | CCTACACTCCAACTCATGAGACC | 2176 | GGTCTCATGAGTTGGAGTGT | 3945 |
| 12914 | 12936 | CCAACTCATGAGACCCACAACAA | 2177 | TTGTTGTGGGTCTCATGAGT | 3946 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 12927 | 12949 | CCCACAACAAATAGCCCTTCTAA | 2178 | TTAGAAGGGCTATTTGTTGT | 3947 |
| 12928 | 12950 | CCACAACAAATAGCCCTTCTAAA | 2179 | TTTAGAAGGGCTATTTGTTG | 3948 |
| 12941 | 12963 | CCCTTCTAAACGCTAATCCAAGC | 2180 | GCTTGGATTAGCGTTTAGAA | 3949 |
| 12942 | 12964 | CCTTCTAAACGCTAATCCAAGCC | 2181 | GGCTTGGATTAGCGTTTAGA | 3950 |
| 12958 | 12980 | CCAAGCCTCACCCCACTACTAGG | 2182 | CCTAGTAGTGGGGTGAGGCT | 3951 |
| 12963 | 12985 | CCTCACCCCACTACTAGGCCTCC | 2183 | GGAGGCCTAGTAGTGGGGTG | 3952 |
| 12968 | 12990 | CCCCACTACTAGGCCTCCTCCTA | 2184 | TAGGAGGAGGCCTAGTAGTG | 3953 |
| 12969 | 12991 | CCCACTACTAGGCCTCCTCCTAG | 2185 | CTAGGAGGAGGCCTAGTAGT | 3954 |
| 12970 | 12992 | CCACTACTAGGCCTCCTCCTAGC | 2186 | GCTAGGAGGAGGCCTAGTAG | 3955 |
| 12981 | 13003 | CCTCCTCCTAGCAGCAGCAGGCA | 2187 | TGCCTGCTGCTGCTAGGAGG | 3956 |
| 12984 | 13006 | CCTCCTAGCAGCAGCAGGCAAAT | 2188 | ATTTGCCTGCTGCTGCTAGG | 3957 |
| 12987 | 13009 | CCTAGCAGCAGCAGGCAAATCAG | 2189 | CTGATTTGCCTGCTGCTGCT | 3958 |
| 13010 | 13032 | CCCAATTAGGTCTCCACCCCTGA | 2190 | TCAGGGGTGGAGACCTAATT | 3959 |
| 13011 | 13033 | CCAATTAGGTCTCCACCCCTGAC | 2191 | GTCAGGGGTGGAGACCTAAT | 3960 |
| 13023 | 13045 | CCACCCCTGACTCCCCTCAGCCA | 2192 | TGGCTGAGGGGAGTCAGGGG | 3961 |
| 13026 | 13048 | CCCCTGACTCCCCTCAGCCATAG | 2193 | CTATGGCTGAGGGGAGTCAG | 3962 |
| 13027 | 13049 | CCCTGACTCCCCTCAGCCATAGA | 2194 | TCTATGGCTGAGGGGAGTCA | 3963 |
| 13028 | 13050 | CCTGACTCCCCTCAGCCATAGAA | 2195 | TTCTATGGCTGAGGGGAGTC | 3964 |
| 13035 | 13057 | CCCCTCAGCCATAGAAGGCCCCA | 2196 | TGGGGCCTTCTATGGCTGAG | 3965 |
| 13036 | 13058 | CCCTCAGCCATAGAAGGCCCCAC | 2197 | GTGGGGCCTTCTATGGCTGA | 3966 |
| 13037 | 13059 | CCTCAGCCATAGAAGGCCCCACC | 2198 | GGTGGGGCCTTCTATGGCTG | 3967 |
| 13043 | 13065 | CCATAGAAGGCCCCACCCCAGTC | 2199 | GACTGGGGTGGGGCCTTCTA | 3968 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 13053 | 13075 | CCCCACCCCAGTCTCAGCCCTAC | 2200 | GTAGGGCTGAGACTGGGGTG | 3969 |
| 13054 | 13076 | CCCACCCCAGTCTCAGCCTACT | 2201 | AGTAGGGCTGAGACTGGGGT | 3970 |
| 13055 | 13077 | CCACCCCAGTCTCAGCCCTACTC | 2202 | GAGTAGGGCTGAGACTGGGG | 3971 |
| 13058 | 13080 | CCCCAGTCTCAGCCCTACTCCAC | 2203 | GTGGAGTAGGGCTGAGACTG | 3972 |
| 13059 | 13081 | CCCAGTCTCAGCCCTACTCCACT | 2204 | AGTGGAGTAGGGCTGAGACT | 3973 |
| 13060 | 13082 | CCAGTCTCAGCCCTACTCCACTC | 2205 | GAGTGGAGTAGGGCTGAGAC | 3974 |
| 13070 | 13092 | CCCTACTCCACTCAAGCACTATA | 2206 | TATAGTGCTTGAGTGGAGTA | 3975 |
| 13071 | 13093 | CCTACTCCACTCAAGCACTATAG | 2207 | CTATAGTGCTTGAGTGGAGT | 3976 |
| 13077 | 13099 | CCACTCAAGCACTATAGTTGTAG | 2208 | CTACAACTATAGTGCTTGAG | 3977 |
| 13119 | 13141 | CCGCTTCCACCCCCTAGCAGAAA | 2209 | TTTCTGCTAGGGGGTGGAAG | 3978 |
| 13125 | 13147 | CCACCCCCTAGCAGAAAATAGCC | 2210 | GGCTATTTTCTGCTAGGGGG | 3979 |
| 13128 | 13150 | CCCCCTAGCAGAAAATAGCCCAC | 2211 | GTGGGCTATTTTCTGCTAGG | 3980 |
| 13129 | 13151 | CCCCTAGCAGAAAATAGCCCACT | 2212 | AGTGGGCTATTTTCTGCTAG | 3981 |
| 13130 | 13152 | CCCTAGCAGAAAATAGCCCACTA | 2213 | TAGTGGGCTATTTTCTGCTA | 3982 |
| 13131 | 13153 | CCTAGCAGAAAATAGCCCACTAA | 2214 | TTAGTGGGCTATTTTCTGCT | 3983 |
| 13146 | 13168 | CCCACTAATCCAAACTCTAACAC | 2215 | GTGTTAGAGTTTGGATTAGT | 3984 |
| 13147 | 13169 | CCACTAATCCAAACTCTAACACT | 2216 | AGTGTTAGAGTTTGGATTAG | 3985 |
| 13155 | 13177 | CCAAACTCTAACACTATGCTTAG | 2217 | CTAAGCATAGTGTTAGAGTT | 3986 |
| 13187 | 13209 | CCACTCTGTTCGCAGCAGTCTGC | 2218 | GCAGACTGCTGCGAACAGAG | 3987 |
| 13211 | 13233 | CCCTTACACAAAATGACATCAAA | 2219 | TTTGATGTCATTTTGTGTAA | 3988 |
| 13212 | 13234 | CCTTACACAAAATGACATCAAAA | 2220 | TTTTGATGTCATTTTGTGTA | 3989 |
| 13244 | 13266 | CCTTCTCCACTTCAAGTCAACTA | 2221 | TAGTTGACTTGAAGTGGAGA | 3990 |
| 13250 | 13272 | CCACTTCAAGTCAACTAGGACTC | 2222 | GAGTCCTAGTTGACTTGAAG | 3991 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 13296 | 13318 | CCAACCACACCTAGCATTCCTGC | 2223 | GCAGGAATGCTAGGTGTGGT | 3992 |
| 13300 | 13322 | CCACACCTAGCATTCCTGCACAT | 2224 | ATGTGCAGGAATGCTAGGTG | 3993 |
| 13305 | 13327 | CCTAGCATTCCTGCACATCTGTA | 2225 | TACAGATGTGCAGGAATGCT | 3994 |
| 13314 | 13336 | CCTGCACATCTGTACCCACGCCT | 2226 | AGGCGTGGGTACAGATGTGC | 3995 |
| 13328 | 13350 | CCCACGCCTTCTTCAAAGCCATA | 2227 | TATGGCTTTGAAGAAGGCGT | 3996 |
| 13329 | 13351 | CCACGCCTTCTTCAAAGCCATAC | 2228 | GTATGGCTTTGAAGAAGGCG | 3997 |
| 13334 | 13356 | CCTTCTTCAAAGCCATACTATTT | 2229 | AAATAGTATGGCTTTGAAGA | 3998 |
| 13346 | 13368 | CCATACTATTTATGTGCTCCGGG | 2230 | CCCGGAGCACATAAATAGTA | 3999 |
| 13364 | 13386 | CCGGGTCCATCATCCACAACCTT | 2231 | AAGGTTGTGGATGATGGACC | 4000 |
| 13370 | 13392 | CCATCATCCACAACCTTAACAAT | 2232 | ATTGTTAAGGTTGTGGATGA | 4001 |
| 13377 | 13399 | CCACAACCTTAACAATGAACAAG | 2233 | CTTGTTCATTGTTAAGGTTG | 4002 |
| 13383 | 13405 | CCTTAACAATGAACAAGATATTC | 2234 | GAATATCTTGTTCATTGTTA | 4003 |
| 13430 | 13452 | CCATACCTCTCACTTCAACCTCC | 2235 | GGAGGTTGAAGTGAGAGGTA | 4004 |
| 13435 | 13457 | CCTCTCACTTCAACCTCCCTCAC | 2236 | GTGAGGGAGGTTGAAGTGAG | 4005 |
| 13448 | 13470 | CCTCCCTCACCATTGGCAGCCTA | 2237 | TAGGCTGCCAATGGTGAGGG | 4006 |
| 13451 | 13473 | CCCTCACCATTGGCAGCCTAGCA | 2238 | TGCTAGGCTGCCAATGGTGA | 4007 |
| 13452 | 13474 | CCTCACCATTGGCAGCCTAGCAT | 2239 | ATGCTAGGCTGCCAATGGTG | 4008 |
| 13457 | 13479 | CCATTGGCAGCCTAGCATTAGCA | 2240 | TGCTAATGCTAGGCTGCCAA | 4009 |
| 13467 | 13489 | CCTAGCATTAGCAGGAATACCTT | 2241 | AAGGTATTCCTGCTAATGCT | 4010 |
| 13486 | 13508 | CCTTTCCTCACAGGTTTCTACTC | 2242 | GAGTAGAAACCTGTGAGGAA | 4011 |
| 13491 | 13513 | CCTCACAGGTTTCTACTCCAAAG | 2243 | CTTTGGAGTAGAAACCTGTG | 4012 |
| 13508 | 13530 | CCAAAGACCACATCATCGAAACC | 2244 | GGTTTCGATGATGTGGTCTT | 4013 |
| 13515 | 13537 | CCACATCATCGAAACCGCAAACA | 2245 | TGTTTGCGGTTTCGATGATG | 4014 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 13529 | 13551 | CCGCAAACATATCATACACAAAC | 2246 | GTTTGTGTATGATATGTTTG | 4015 |
| 13553 | 13575 | CCTGAGCCCTATCTATTACTCTC | 2247 | GAGAGTAATAGATAGGGCTC | 4016 |
| 13559 | 13581 | CCCTATCTATTACTCTCATCGCT | 2248 | AGCGATGAGAGTAATAGATA | 4017 |
| 13560 | 13582 | CCTATCTATTACTCTCATCGCTA | 2249 | TAGCGATGAGAGTAATAGAT | 4018 |
| 13583 | 13605 | CCTCCCTGACAAGCGCCTATAGC | 2250 | GCTATAGGCGCTTGTCAGGG | 4019 |
| 13586 | 13608 | CCCTGACAAGCGCCTATAGCACT | 2251 | AGTGCTATAGGCGCTTGTCA | 4020 |
| 13587 | 13609 | CCTGACAAGCGCCTATAGCACTC | 2252 | GAGTGCTATAGGCGCTTGTC | 4021 |
| 13598 | 13620 | CCTATAGCACTCGAATAATTCTT | 2253 | AAGAATTATTCGAGTGCTAT | 4022 |
| 13625 | 13647 | CCCTAACAGGTCAACCTCGCTTC | 2254 | GAAGCGAGGTTGACCTGTTA | 4023 |
| 13626 | 13648 | CCTAACAGGTCAACCTCGCTTCC | 2255 | GGAAGCGAGGTTGACCTGTT | 4024 |
| 13639 | 13661 | CCTCGCTTCCCCACCCTTACTAA | 2256 | TTAGTAAGGGTGGGGAAGCG | 4025 |
| 13647 | 13669 | CCCCACCCTTACTAACATTAACG | 2257 | CGTTAATGTTAGTAAGGGTG | 4026 |
| 13648 | 13670 | CCCACCCTTACTAACATTAACGA | 2258 | TCGTTAATGTTAGTAAGGGT | 4027 |
| 13649 | 13671 | CCACCCTTACTAACATTAACGAA | 2259 | TTCGTTAATGTTAGTAAGGG | 4028 |
| 13652 | 13674 | CCCTTACTAACATTAACGAAAAT | 2260 | ATTTTCGTTAATGTTAGTAA | 4029 |
| 13653 | 13675 | CCTTACTAACATTAACGAAAATA | 2261 | TATTTTCGTTAATGTTAGTA | 4030 |
| 13677 | 13699 | CCCCACCCTACTAAACCCCATTA | 2262 | TAATGGGGTTTAGTAGGGTG | 4031 |
| 13678 | 13700 | CCCACCCTACTAAACCCCATTAA | 2263 | TTAATGGGGTTTAGTAGGGT | 4032 |
| 13679 | 13701 | CCACCCTACTAAACCCCATTAAA | 2264 | TTTAATGGGGTTTAGTAGGG | 4033 |
| 13682 | 13704 | CCCTACTAAACCCCATTAAACGC | 2265 | GCGTTTAATGGGGTTTAGTA | 4034 |
| 13683 | 13705 | CCTACTAAACCCCATTAAACGCC | 2266 | GGCGTTTAATGGGGTTTAGT | 4035 |
| 13692 | 13714 | CCCCATTAAACGCCTGGCAGCCG | 2267 | CGGCTGCCAGGCGTTTAATG | 4036 |
| 13693 | 13715 | CCCATTAAACGCCTGGCAGCCGG | 2268 | CCGGCTGCCAGGCGTTTAAT | 4037 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 13694 | 13716 | CCATTAAACGCCTGGCAGCCGGA | 2269 | TCCGGCTGCCAGGCGTTTAA | 4038 |
| 13704 | 13726 | CCTGGCAGCCGGAAGCCTATTCG | 2270 | CGAATAGGCTTCCGGCTGCC | 4039 |
| 13712 | 13734 | CCGGAAGCCTATTCGCAGGATTT | 2271 | AAATCCTGCGAATAGGCTTC | 4040 |
| 13719 | 13741 | CCTATTCGCAGGATTTCTCATTA | 2272 | TAATGAGAAATCCTGCGAAT | 4041 |
| 13754 | 13776 | CCCCCGCATCCCCCTTCCAAACA | 2273 | TGTTTGGAAGGGGGATGCGG | 4042 |
| 13755 | 13777 | CCCCGCATCCCCCTTCCAAACAA | 2274 | TTGTTTGGAAGGGGGATGCG | 4043 |
| 13756 | 13778 | CCCGCATCCCCCTTCCAAACAAC | 2275 | GTTGTTTGGAAGGGGGATGC | 4044 |
| 13757 | 13779 | CCGCATCCCCCTTCCAAACAACA | 2276 | TGTTGTTTGGAAGGGGGATG | 4045 |
| 13763 | 13785 | CCCCCTTCCAAACAACAATCCCC | 2277 | GGGGATTGTTGTTTGGAAGG | 4046 |
| 13764 | 13786 | CCCCTTCCAAACAACAATCCCCC | 2278 | GGGGGATTGTTGTTTGGAAG | 4047 |
| 13765 | 13787 | CCCTTCCAAACAACAATCCCCCT | 2279 | AGGGGGATTGTTGTTTGGAA | 4048 |
| 13766 | 13788 | CCTTCCAAACAACAATCCCCCTC | 2280 | GAGGGGGATTGTTGTTTGGA | 4049 |
| 13770 | 13792 | CCAAACAACAATCCCCCTCTACC | 2281 | GGTAGAGGGGGATTGTTGTT | 4050 |
| 13782 | 13804 | CCCCCTCTACCTAAAACTCACAG | 2282 | CTGTGAGTTTTAGGTAGAGG | 4051 |
| 13783 | 13805 | CCCCTCTACCTAAAACTCACAGC | 2283 | GCTGTGAGTTTTAGGTAGAG | 4052 |
| 13784 | 13806 | CCCTCTACCTAAAACTCACAGCC | 2284 | GGCTGTGAGTTTTAGGTAGA | 4053 |
| 13785 | 13807 | CCTCTACCTAAAACTCACAGCCC | 2285 | GGGCTGTGAGTTTTAGGTAG | 4054 |
| 13791 | 13813 | CCTAAAACTCACAGCCCTCGCTG | 2286 | CAGCGAGGGCTGTGAGTTTT | 4055 |
| 13805 | 13827 | CCCTCGCTGTCACTTTCCTAGGA | 2287 | TCCTAGGAAAGTGACAGCGA | 4056 |
| 13806 | 13828 | CCTCGCTGTCACTTTCCTAGGAC | 2288 | GTCCTAGGAAAGTGACAGCG | 4057 |
| 13821 | 13843 | CCTAGGACTTCTAACAGCCCTAG | 2289 | CTAGGGCTGTTAGAAGTCCT | 4058 |
| 13838 | 13860 | CCCTAGACCTCAACTACCTAACC | 2290 | GGTTAGGTAGTTGAGGTCTA | 4059 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 13839 | 13861 | CCTAGACCTCAACTACCTAACCA | 2291 | TGGTTAGGTAGTTGAGGTCT | 4060 |
| 13845 | 13867 | CCTCAACTACCTAACCAACAAAC | 2292 | GTTTGTTGGTTAGGTAGTTG | 4061 |
| 13854 | 13876 | CCTAACCAACAAACTTAAAATAA | 2293 | TTATTTTAAGTTTGTTGGTT | 4062 |
| 13859 | 13881 | CCAACAAACTTAAAATAAAATCC | 2294 | GGATTTTATTTTAAGTTTGT | 4063 |
| 13880 | 13902 | CCCCACTATGCACATTTTATTTC | 2295 | GAAATAAAATGTGCATAGTG | 4064 |
| 13881 | 13903 | CCCACTATGCACATTTTATTTCT | 2296 | AGAAATAAAATGTGCATAGT | 4065 |
| 13882 | 13904 | CCACTATGCACATTTTATTTCTC | 2297 | GAGAAATAAAATGTGCATAG | 4066 |
| 13904 | 13926 | CCAACATACTCGGATTCTACCCT | 2298 | AGGGTAGAATCCGAGTATGT | 4067 |
| 13923 | 13945 | CCCTAGCATCACACACCGCACAA | 2299 | TTGTGCGGTGTGTGATGCTA | 4068 |
| 13924 | 13946 | CCTAGCATCACACACCGCACAAT | 2300 | ATTGTGCGGTGTGTGATGCT | 4069 |
| 13938 | 13960 | CCGCACAATCCCCTATCTAGGCC | 2301 | GGCCTAGATAGGGGATTGTG | 4070 |
| 13947 | 13969 | CCCCTATCTAGGCCTTCTTACGA | 2302 | TCGTAAGAAGGCCTAGATAG | 4071 |
| 13948 | 13970 | CCCTATCTAGGCCTTCTTACGAG | 2303 | CTCGTAAGAAGGCCTAGATA | 4072 |
| 13949 | 13971 | CCTATCTAGGCCTTCTTACGAGC | 2304 | GCTCGTAAGAAGGCCTAGAT | 4073 |
| 13959 | 13981 | CCTTCTTACGAGCCAAAACCTGC | 2305 | GCAGGTTTTGGCTCGTAAGA | 4074 |
| 13971 | 13993 | CCAAAACCTGCCCCTACTCCTCC | 2306 | GGAGGAGTAGGGGCAGGTTT | 4075 |
| 13977 | 13999 | CCTGCCCCTACTCCTCCTAGACC | 2307 | GGTCTAGGAGGAGTAGGGGC | 4076 |
| 13981 | 14003 | CCCCTACTCCTCCTAGACCTAAC | 2308 | GTTAGGTCTAGGAGGAGTAG | 4077 |
| 13982 | 14004 | CCCTACTCCTCCTAGACCTAACC | 2309 | GGTTAGGTCTAGGAGGAGTA | 4078 |
| 13983 | 14005 | CCTACTCCTCCTAGACCTAACCT | 2310 | AGGTTAGGTCTAGGAGGAGT | 4079 |
| 13989 | 14011 | CCTCCTAGACCTAACCTGACTAG | 2311 | CTAGTCAGGTTAGGTCTAGG | 4080 |
| 13992 | 14014 | CCTAGACCTAACCTGACTAGAAA | 2312 | TTTCTAGTCAGGTTAGGTCT | 4081 |
| 13998 | 14020 | CCTAACCTGACTAGAAAAGCTAT | 2313 | ATAGCTTTTCTAGTCAGGTT | 4082 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 14003 | 14025 | CCTGACTAGAAAAGCTATTACCT | 2314 | AGGTAATAGCTTTTCTAGTC | 4083 |
| 14023 | 14045 | CCTAAAACAATTTCACAGCACCA | 2315 | TGGTGCTGTGAAATTGTTTT | 4084 |
| 14043 | 14065 | CCAAATCTCCACCTCCATCATCA | 2316 | TGATGATGGAGGTGGAGATT | 4085 |
| 14051 | 14073 | CCACCTCCATCATCACCTCAACC | 2317 | GGTTGAGGTGATGATGGAGG | 4086 |
| 14054 | 14076 | CCTCCATCATCACCTCAACCCAA | 2318 | TTGGGTTGAGGTGATGATGG | 4087 |
| 14057 | 14079 | CCATCATCACCTCAACCCAAAAA | 2319 | TTTTTGGGTTGAGGTGATGA | 4088 |
| 14066 | 14088 | CCTCAACCCAAAAGGCATAATT | 2320 | AATTATGCCTTTTTGGGTTG | 4089 |
| 14072 | 14094 | CCCAAAAGGCATAATTAAACTT | 2321 | AAGTTTAATTATGCCTTTTT | 4090 |
| 14073 | 14095 | CCAAAAGGCATAATTAAACTTT | 2322 | AAAGTTTAATTATGCCTTTT | 4091 |
| 14100 | 14122 | CCTCTCTTTCTTCTTCCCACTCA | 2323 | TGAGTGGGAAGAAGAAAGAG | 4092 |
| 14115 | 14137 | CCCACTCATCCTAACCCTACTCC | 2324 | GGAGTAGGGTTAGGATGAGT | 4093 |
| 14116 | 14138 | CCACTCATCCTAACCCTACTCCT | 2325 | AGGAGTAGGGTTAGGATGAG | 4094 |
| 14124 | 14146 | CCTAACCCTACTCCTAATCACAT | 2326 | ATGTGATTAGGAGTAGGGTT | 4095 |
| 14129 | 14151 | CCCTACTCCTAATCACATAACCT | 2327 | AGGTTATGTGATTAGGAGTA | 4096 |
| 14130 | 14152 | CCTACTCCTAATCACATAACCTA | 2328 | TAGGTTATGTGATTAGGAGT | 4097 |
| 14136 | 14158 | CCTAATCACATAACCTATTCCCC | 2329 | GGGGAATAGGTTATGTGATT | 4098 |
| 14149 | 14171 | CCTATTCCCCCGAGCAATCTCAA | 2330 | TTGAGATTGCTCGGGGGAAT | 4099 |
| 14155 | 14177 | CCCCCGAGCAATCTCAATTACAA | 2331 | TTGTAATTGAGATTGCTCGG | 4100 |
| 14156 | 14178 | CCCCGAGCAATCTCAATTACAAT | 2332 | ATTGTAATTGAGATTGCTCG | 4101 |
| 14157 | 14179 | CCCGAGCAATCTCAATTACAATA | 2333 | TATTGTAATTGAGATTGCTC | 4102 |
| 14158 | 14180 | CCGAGCAATCTCAATTACAATAT | 2334 | ATATTGTAATTGAGATTGCT | 4103 |
| 14186 | 14208 | CCAACAAACAATGTTCAACCAGT | 2335 | ACTGGTTGAACATTGTTTGT | 4104 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 14204 | 14226 | CCAGTAACTACTACTAATCAACG | 2336 | CGTTGATTAGTAGTAGTTAC | 4105 |
| 14227 | 14249 | CCCATAATCATACAAAGCCCCCG | 2337 | CGGGGGCTTTGTATGATTAT | 4106 |
| 14228 | 14250 | CCATAATCATACAAAGCCCCGC | 2338 | GCGGGGCTTTGTATGATTA | 4107 |
| 14244 | 14266 | CCCCCGCACCAATAGGATCCTCC | 2339 | GGAGGATCCTATTGGTGCGG | 4108 |
| 14245 | 14267 | CCCCGCACCAATAGGATCCTCCC | 2340 | GGGAGGATCCTATTGGTGCG | 4109 |
| 14246 | 14268 | CCCGCACCAATAGGATCCTCCCG | 2341 | CGGGAGGATCCTATTGGTGC | 4110 |
| 14247 | 14269 | CCGCACCAATAGGATCCTCCCGA | 2342 | TCGGGAGGATCCTATTGGTG | 4111 |
| 14252 | 14274 | CCAATAGGATCCTCCCGAATCAA | 2343 | TTGATTCGGGAGGATCCTAT | 4112 |
| 14262 | 14284 | CCTCCCGAATCAACCCTGACCCC | 2344 | GGGGTCAGGGTTGATTCGGG | 4113 |
| 14265 | 14287 | CCCGAATCAACCCTGACCCCTCT | 2345 | AGAGGGGTCAGGGTTGATTC | 4114 |
| 14266 | 14288 | CCGAATCAACCCTGACCCCTCTC | 2346 | GAGAGGGGTCAGGGTTGATT | 4115 |
| 14275 | 14297 | CCCTGACCCCTCTCCTTCATAAA | 2347 | TTTATGAAGGAGAGGGGTCA | 4116 |
| 14276 | 14298 | CCTGACCCCTCTCCTTCATAAAT | 2348 | ATTTATGAAGGAGAGGGGTC | 4117 |
| 14281 | 14303 | CCCCTCTCCTTCATAAATTATTC | 2349 | GAATAATTTATGAAGGAGAG | 4118 |
| 14282 | 14304 | CCCTCTCCTTCATAAATTATTCA | 2350 | TGAATAATTTATGAAGGAGA | 4119 |
| 14283 | 14305 | CCTCTCCTTCATAAATTATTCAG | 2351 | CTGAATAATTTATGAAGGAG | 4120 |
| 14288 | 14310 | CCTTCATAAATTATTCAGCTTCC | 2352 | GGAAGCTGAATAATTTATGA | 4121 |
| 14309 | 14331 | CCTACACTATTAAAGTTTACCAC | 2353 | GTGGTAAACTTTAATAGTGT | 4122 |
| 14328 | 14350 | CCACAACCACCACCCCATCATAC | 2354 | GTATGATGGGTGGTGGTTG | 4123 |
| 14334 | 14356 | CCACCACCCCATCATACTCTTTC | 2355 | GAAAGAGTATGATGGGGTGG | 4124 |
| 14337 | 14359 | CCACCCCATCATACTCTTTCACC | 2356 | GGTGAAAGAGTATGATGGGG | 4125 |
| 14340 | 14362 | CCCCATCATACTCTTTCACCCAC | 2357 | GTGGGTGAAAGAGTATGATG | 4126 |
| 14341 | 14363 | CCCATCATACTCTTTCACCCACA | 2358 | TGTGGGTGAAAGAGTATGAT | 4127 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 14342 | 14364 | CCATCATACTCTTTCACCCACAG | 2359 | CTGTGGGTGAAAGAGTATGA | 4128 |
| 14358 | 14380 | CCCACAGCACCAATCCTACCTCC | 2360 | GGAGGTAGGATTGGTGCTGT | 4129 |
| 14359 | 14381 | CCACAGCACCAATCCTACCTCCA | 2361 | TGGAGGTAGGATTGGTGCTG | 4130 |
| 14367 | 14389 | CCAATCCTACCTCCATCGCTAAC | 2362 | GTTAGCGATGGAGGTAGGAT | 4131 |
| 14372 | 14394 | CCTACCTCCATCGCTAACCCCAC | 2363 | GTGGGGTTAGCGATGGAGGT | 4132 |
| 14376 | 14398 | CCTCCATCGCTAACCCCACTAAA | 2364 | TTTAGTGGGGTTAGCGATGG | 4133 |
| 14379 | 14401 | CCATCGCTAACCCCACTAAAACA | 2365 | TGTTTTAGTGGGGTTAGCGA | 4134 |
| 14389 | 14411 | CCCCACTAAAACACTCACCAAGA | 2366 | TCTTGGTGAGTGTTTTAGTG | 4135 |
| 14390 | 14412 | CCCACTAAAACACTCACCAAGAC | 2367 | GTCTTGGTGAGTGTTTTAGT | 4136 |
| 14391 | 14413 | CCACTAAAACACTCACCAAGACC | 2368 | GGTCTTGGTGAGTGTTTTAG | 4137 |
| 14406 | 14428 | CCAAGACCTCAACCCCTGACCCC | 2369 | GGGGTCAGGGGTTGAGGTCT | 4138 |
| 14412 | 14434 | CCTCAACCCCTGACCCCCATGCC | 2370 | GGCATGGGGGTCAGGGGTTG | 4139 |
| 14418 | 14440 | CCCCTGACCCCCATGCCTCAGGA | 2371 | TCCTGAGGCATGGGGGTCAG | 4140 |
| 14419 | 14441 | CCCTGACCCCCATGCCTCAGGAT | 2372 | ATCCTGAGGCATGGGGGTCA | 4141 |
| 14420 | 14442 | CCTGACCCCCATGCCTCAGGATA | 2373 | TATCCTGAGGCATGGGGGTC | 4142 |
| 14425 | 14447 | CCCCCATGCCTCAGGATACTCCT | 2374 | AGGAGTATCCTGAGGCATGG | 4143 |
| 14426 | 14448 | CCCCATGCCTCAGGATACTCCTC | 2375 | GAGGAGTATCCTGAGGCATG | 4144 |
| 14427 | 14449 | CCCATGCCTCAGGATACTCCTCA | 2376 | TGAGGAGTATCCTGAGGCAT | 4145 |
| 14428 | 14450 | CCATGCCTCAGGATACTCCTCAA | 2377 | TTGAGGAGTATCCTGAGGCA | 4146 |
| 14433 | 14455 | CCTCAGGATACTCCTCAATAGCC | 2378 | GGCTATTGAGGAGTATCCTG | 4147 |
| 14445 | 14467 | CCTCAATAGCCATCGCTGTAGTA | 2379 | TACTACAGCGATGGCTATTG | 4148 |
| 14454 | 14476 | CCATCGCTGTAGTATATCCAAAG | 2380 | CTTTGGATATACTACAGCGA | 4149 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 14471 | 14493 | CCAAAGACAACCATCATTCCCCC | 2381 | GGGGGAATGATGGTTGTCTT | 4150 |
| 14481 | 14503 | CCATCATTCCCCCTAAATAAATT | 2382 | AATTTATTTAGGGGGAATGA | 4151 |
| 14489 | 14511 | CCCCCTAAATAAATTAAAAAAC | 2383 | GTTTTTTTAATTTATTTAGG | 4152 |
| 14490 | 14512 | CCCCTAAATAAATTAAAAAACT | 2384 | AGTTTTTTTAATTTATTTAG | 4153 |
| 14491 | 14513 | CCCTAAATAAATTAAAAAACTA | 2385 | TAGTTTTTTTAATTTATTTA | 4154 |
| 14492 | 14514 | CCTAAATAAATTAAAAAACTAT | 2386 | ATAGTTTTTTTAATTTATTT | 4155 |
| 14519 | 14541 | CCCATATAACCTCCCCCAAAATT | 2387 | AATTTTGGGGGAGGTTATAT | 4156 |
| 14520 | 14542 | CCATATAACCTCCCCCAAAATTC | 2388 | GAATTTTGGGGGAGGTTATA | 4157 |
| 14528 | 14550 | CCTCCCCCAAAATTCAGAATAAT | 2389 | ATTATTCTGAATTTTGGGG | 4158 |
| 14531 | 14553 | CCCCCAAAATTCAGAATAATAAC | 2390 | GTTATTATTCTGAATTTTGG | 4159 |
| 14532 | 14554 | CCCCAAAATTCAGAATAATAACA | 2391 | TGTTATTATTCTGAATTTTG | 4160 |
| 14533 | 14555 | CCCAAAATTCAGAATAATAACAC | 2392 | GTGTTATTATTCTGAATTTT | 4161 |
| 14534 | 14556 | CCAAAATTCAGAATAATAACACA | 2393 | TGTGTTATTATTCTGAATTT | 4162 |
| 14557 | 14579 | CCCGACCACACCGCTAACAATCA | 2394 | TGATTGTTAGCGGTGTGGTC | 4163 |
| 14558 | 14580 | CCGACCACACCGCTAACAATCAA | 2395 | TTGATTGTTAGCGGTGTGGT | 4164 |
| 14562 | 14584 | CCACACCGCTAACAATCAATACT | 2396 | AGTATTGATTGTTAGCGGTG | 4165 |
| 14567 | 14589 | CCGCTAACAATCAATACTAAACC | 2397 | GGTTTAGTATTGATTGTTAG | 4166 |
| 14588 | 14610 | CCCCCATAAATAGGAGAAGGCTT | 2398 | AAGCCTTCTCCTATTTATGG | 4167 |
| 14589 | 14611 | CCCCATAAATAGGAGAAGGCTTA | 2399 | TAAGCCTTCTCCTATTTATG | 4168 |
| 14590 | 14612 | CCCATAAATAGGAGAAGGCTTAG | 2400 | CTAAGCCTTCTCCTATTTAT | 4169 |
| 14591 | 14613 | CCATAAATAGGAGAAGGCTTAGA | 2401 | TCTAAGCCTTCTCCTATTTA | 4170 |
| 14620 | 14642 | CCCCACAAACCCCATTACTAAAC | 2402 | GTTTAGTAATGGGGTTTGTG | 4171 |
| 14621 | 14643 | CCCACAAACCCCATTACTAAACC | 2403 | GGTTTAGTAATGGGGTTTGT | 4172 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 14622 | 14644 | CCACAAACCCCATTACTAAACCC | 2404 | GGGTTTAGTAATGGGGTTTG | 4173 |
| 14629 | 14651 | CCCCATTACTAAACCCACACTCA | 2405 | TGAGTGTGGGTTTAGTAATG | 4174 |
| 14630 | 14652 | CCCATTACTAAACCCACACTCAA | 2406 | TTGAGTGTGGGTTTAGTAAT | 4175 |
| 14631 | 14653 | CCATTACTAAACCCACACTCAAC | 2407 | GTTGAGTGTGGGTTTAGTAA | 4176 |
| 14642 | 14664 | CCCACACTCAACAGAAACAAAGC | 2408 | GCTTTGTTTCTGTTGAGTGT | 4177 |
| 14643 | 14665 | CCACACTCAACAGAAACAAAGCA | 2409 | TGCTTTGTTTCTGTTGAGTG | 4178 |
| 14694 | 14716 | CCACGACCAATGATATGAAAAAC | 2410 | GTTTTTCATATCATTGGTCG | 4179 |
| 14700 | 14722 | CCAATGATATGAAAAACCATCGT | 2411 | ACGATGGTTTTTCATATCAT | 4180 |
| 14716 | 14738 | CCATCGTTGTATTTCAACTACAA | 2412 | TTGTAGTTGAAATACAACGA | 4181 |
| 14744 | 14766 | CCAATGACCCCAATACGCAAAAC | 2413 | GTTTTGCGTATTGGGGTCAT | 4182 |
| 14751 | 14773 | CCCCAATACGCAAAACTAACCCC | 2414 | GGGGTTAGTTTTGCGTATTG | 4183 |
| 14752 | 14774 | CCCAATACGCAAAACTAACCCCC | 2415 | GGGGGTTAGTTTTGCGTATT | 4184 |
| 14753 | 14775 | CCAATACGCAAAACTAACCCCCT | 2416 | AGGGGGTTAGTTTTGCGTAT | 4185 |
| 14770 | 14792 | CCCCTAATAAAATTAATTAACC | 2417 | GGTTAATTAATTTTATTAGG | 4186 |
| 14771 | 14793 | CCCTAATAAAATTAATTAACCA | 2418 | TGGTTAATTAATTTTATTAG | 4187 |
| 14772 | 14794 | CCCTAATAAAATTAATTAACCAC | 2419 | GTGGTTAATTAATTTTATTA | 4188 |
| 14773 | 14795 | CCTAATAAAATTAATTAACCACT | 2420 | AGTGGTTAATTAATTTTATT | 4189 |
| 14791 | 14813 | CCACTCATTCATCGACCTCCCCA | 2421 | TGGGGAGGTCGATGAATGAG | 4190 |
| 14806 | 14828 | CCTCCCCACCCCATCCAACATCT | 2422 | AGATGTTGGATGGGGTGGGG | 4191 |
| 14809 | 14831 | CCCCACCCCATCCAACATCTCCG | 2423 | CGGAGATGTTGGATGGGGTG | 4192 |
| 14810 | 14832 | CCCACCCCATCCAACATCTCCGC | 2424 | GCGGAGATGTTGGATGGGGT | 4193 |
| 14811 | 14833 | CCACCCCATCCAACATCTCCGCA | 2425 | TGCGGAGATGTTGGATGGGG | 4194 |
| 14814 | 14836 | CCCCATCCAACATCTCCGCATGA | 2426 | TCATGCGGAGATGTTGGATG | 4195 |

TABLE 4-continued gRNA target sequence for human mtDNA carrying NGG sequence on the (−) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 14815 | 14837 | CCCATCCAACATCTCCGCATGAT | 2427 | ATCATGCGGAGATGTTGGAT | 4196 |
| 14816 | 14838 | CCATCCAACATCTCCGCATGATG | 2428 | CATCATGCGGAGATGTTGGA | 4197 |
| 14820 | 14842 | CCAACATCTCCGCATGATGAAAC | 2429 | GTTTCATCATGCGGAGATGT | 4198 |
| 14829 | 14851 | CCGCATGATGAAACTTCGGCTCA | 2430 | TGAGCCGAAGTTTCATCATG | 4199 |
| 14854 | 14876 | CCTTGGCGCCTGCCTGATCCTCC | 2431 | GGAGGATCAGGCAGGCGCCA | 4200 |
| 14862 | 14884 | CCTGCCTGATCCTCCAAATCACC | 2432 | GGTGATTTGGAGGATCAGGC | 4201 |
| 14866 | 14888 | CCTGATCCTCCAAATCACCACAG | 2433 | CTGTGGTGATTTGGAGGATC | 4202 |
| 14872 | 14894 | CCTCCAAATCACCACAGGACTAT | 2434 | ATAGTCCTGTGGTGATTTGG | 4203 |
| 14875 | 14897 | CCAAATCACCACAGGACTATTCC | 2435 | GGAATAGTCCTGTGGTGATT | 4204 |
| 14883 | 14905 | CCACAGGACTATTCCTAGCCATG | 2436 | CATGGCTAGGAATAGTCCTG | 4205 |
| 14896 | 14918 | CCTAGCCATGCACTACTCACCAG | 2437 | CTGGTGAGTAGTGCATGGCT | 4206 |
| 14901 | 14923 | CCATGCACTACTCACCAGACGCC | 2438 | GGCGTCTGGTGAGTAGTGCA | 4207 |
| 14915 | 14937 | CCAGACGCCTCAACCGCCTTTTC | 2439 | GAAAAGGCGGTTGAGGCGTC | 4208 |
| 14922 | 14944 | CCTCAACCGCCTTTTCATCAATC | 2440 | GATTGATGAAAAGGCGGTTG | 4209 |
| 14928 | 14950 | CCGCCTTTTCATCAATCGCCCAC | 2441 | GTGGGCGATTGATGAAAAGG | 4210 |
| 14931 | 14953 | CCTTTTCATCAATCGCCCACATC | 2442 | GATGTGGGCGATTGATGAAA | 4211 |
| 14946 | 14968 | CCCACATCACTCGAGACGTAAAT | 2443 | ATTTACGTCTCGAGTGATGT | 4212 |
| 14947 | 14969 | CCACATCACTCGAGACGTAAATT | 2444 | AATTTACGTCTCGAGTGATG | 4213 |
| 14983 | 15005 | CCGCTACCTTCACGCCAATGGCG | 2445 | CGCCATTGGCGTGAAGGTAG | 4214 |
| 14989 | 15011 | CCTTCACGCCAATGGCGCCTCAA | 2446 | TTGAGGCGCCATTGGCGTGA | 4215 |
| 14997 | 15019 | CCAATGGCGCCTCAATATTCTTT | 2447 | AAAGAATATTGAGGCGCCAT | 4216 |
| 15006 | 15028 | CCTCAATATTCTTTATCTGCCTC | 2448 | GAGGCAGATAAAGAATATTG | 4217 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 15025 | 15047 | CCTCTTCCTACACATCGGGCGAG | 2449 | CTCGCCCGATGTGTAGGAAG | 4218 |
| 15031 | 15053 | CCTACACATCGGGCGAGGCCTAT | 2450 | ATAGGCCTCGCCCGATGTGT | 4219 |
| 15049 | 15071 | CCTATATTACGGATCATTTCTCT | 2451 | AGAGAAATGATCCGTAATAT | 4220 |
| 15081 | 15103 | CCTGAAACATCGGCATTATCCTC | 2452 | GAGGATAATGCCGATGTTTC | 4221 |
| 15100 | 15122 | CCTCCTGCTTGCAACTATAGCAA | 2453 | TTGCTATAGTTGCAAGCAGG | 4222 |
| 15103 | 15125 | CCTGCTTGCAACTATAGCAACAG | 2454 | CTGTTGCTATAGTTGCAAGC | 4223 |
| 15126 | 15148 | CCTTCATAGGCTATGTCCTCCCG | 2455 | CGGGAGGACATAGCCTATGA | 4224 |
| 15142 | 15164 | CCTCCCGTGAGGCCAAATATCAT | 2456 | ATGATATTTGGCCTCACGGG | 4225 |
| 15145 | 15167 | CCCGTGAGGCCAAATATCATTCT | 2457 | AGAATGATATTTGGCCTCAC | 4226 |
| 15146 | 15168 | CCGTGAGGCCAAATATCATTCTG | 2458 | CAGAATGATATTTGGCCTCA | 4227 |
| 15154 | 15176 | CCAAATATCATTCTGAGGGGCCA | 2459 | TGGCCCCTCAGAATGATATT | 4228 |
| 15174 | 15196 | CCACAGTAATTACAAACTTACTA | 2460 | TAGTAAGTTTGTAATTACTG | 4229 |
| 15198 | 15220 | CCGCCATCCCATACATTGGGACA | 2461 | TGTCCCAATGTATGGGATGG | 4230 |
| 15201 | 15223 | CCATCCCATACATTGGGACAGAC | 2462 | GTCTGTCCCAATGTATGGGA | 4231 |
| 15205 | 15227 | CCCATACATTGGGACAGACCTAG | 2463 | CTAGGTCTGTCCCAATGTAT | 4232 |
| 15206 | 15228 | CCATACATTGGGACAGACCTAGT | 2464 | ACTAGGTCTGTCCCAATGTA | 4233 |
| 15223 | 15245 | CCTAGTTCAATGAATCTGAGGAG | 2465 | CTCCTCAGATTCATTGAACT | 4234 |
| 15263 | 15285 | CCCACCCTCACACGATTCTTTAC | 2466 | GTAAAGAATCGTGTGAGGGT | 4235 |
| 15264 | 15286 | CCACCCTCACACGATTCTTTACC | 2467 | GGTAAAGAATCGTGTGAGGG | 4236 |
| 15267 | 15289 | CCCTCACACGATTCTTTACCTTT | 2468 | AAAGGTAAAGAATCGTGTGA | 4237 |
| 15268 | 15290 | CCTCACACGATTCTTTACCTTTC | 2469 | GAAAGGTAAAGAATCGTGTG | 4238 |
| 15285 | 15307 | CCTTTCACTTCATCTTGCCCTTC | 2470 | GAAGGGCAAGATGAAGTGAA | 4239 |
| 15302 | 15324 | CCCTTCATTATTGCAGCCCTAGC | 2471 | GCTAGGGCTGCAATAATGAA | 4240 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 15303 | 15325 | CCTTCATTATTGCAGCCCTAGCA | 2472 | TGCTAGGGCTGCAATAATGA | 4241 |
| 15318 | 15340 | CCCTAGCAACACTCCACCTCCTA | 2473 | TAGGAGGTGGAGTGTTGCTA | 4242 |
| 15319 | 15341 | CCTAGCAACACTCCACCTCCTAT | 2474 | ATAGGAGGTGGAGTGTTGCT | 4243 |
| 15331 | 15353 | CCACCTCCTATTCTTGCACGAAA | 2475 | TTTCGTGCAAGAATAGGAGG | 4244 |
| 15334 | 15356 | CCTCCTATTCTTGCACGAAACGG | 2476 | CCGTTTCGTGCAAGAATAGG | 4245 |
| 15337 | 15359 | CCTATTCTTGCACGAAACGGGAT | 2477 | ATCCCGTTTCGTGCAAGAAT | 4246 |
| 15367 | 15389 | CCCCCTAGGAATCACCTCCCATT | 2478 | AATGGGAGGTGATTCCTAGG | 4247 |
| 15368 | 15390 | CCCCTAGGAATCACCTCCCATTC | 2479 | GAATGGGAGGTGATTCCTAG | 4248 |
| 15369 | 15391 | CCCTAGGAATCACCTCCCATTCC | 2480 | GGAATGGGAGGTGATTCCTA | 4249 |
| 15370 | 15392 | CCTAGGAATCACCTCCCATTCCG | 2481 | CGGAATGGGAGGTGATTCCT | 4250 |
| 15381 | 15403 | CCTCCCATTCCGATAAAATCACC | 2482 | GGTGATTTTATCGGAATGGG | 4251 |
| 15384 | 15406 | CCCATTCCGATAAAATCACCTTC | 2483 | GAAGGTGATTTTATCGGAAT | 4252 |
| 15385 | 15407 | CCATTCCGATAAAATCACCTTCC | 2484 | GGAAGGTGATTTTATCGGAA | 4253 |
| 15390 | 15412 | CCGATAAAATCACCTTCCACCCT | 2485 | AGGGTGGAAGGTGATTTTAT | 4254 |
| 15402 | 15424 | CCTTCCACCCTTACTACACAATC | 2486 | GATTGTGTAGTAAGGGTGGA | 4255 |
| 15406 | 15428 | CCACCCTTACTACACAATCAAAG | 2487 | CTTTGATTGTGTAGTAAGGG | 4256 |
| 15409 | 15431 | CCCTTACTACACAATCAAAGACG | 2488 | CGTCTTTGATTGTGTAGTAA | 4257 |
| 15410 | 15432 | CCTTACTACACAATCAAAGACGC | 2489 | GCGTCTTTGATTGTGTAGTA | 4258 |
| 15432 | 15454 | CCCTCGGCTTACTTCTCTTCCTT | 2490 | AAGGAAGAGAAGTAAGCCGA | 4259 |
| 15433 | 15455 | CCTCGGCTTACTTCTCTTCCTTC | 2491 | GAAGGAAGAGAAGTAAGCCG | 4260 |
| 15451 | 15473 | CCTTCTCTCCTTAATGACATTAA | 2492 | TTAATGTCATTAAGGAGAGA | 4261 |
| 15459 | 15481 | CCTTAATGACATTAACCTATTC | 2493 | GAATAGTGTTAATGTCATTA | 4262 |
| 15485 | 15507 | CCAGACCTCCTAGGCGACCCAGA | 2494 | TCTGGGTCGCCTAGGAGGTC | 4263 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 15490 | 15512 | CCTCCTAGGCGACCCAGACAATT | 2495 | AATTGTCTGGGTCGCCTAGG | 4264 |
| 15493 | 15515 | CCTAGGCGACCCAGACAATTATA | 2496 | TATAATTGTCTGGGTCGCCT | 4265 |
| 15502 | 15524 | CCCAGACAATTATACCCTAGCCA | 2497 | TGGCTAGGGTATAATTGTCT | 4266 |
| 15503 | 15525 | CCAGACAATTATACCCTAGCCAA | 2498 | TTGGCTAGGGTATAATTGTC | 4267 |
| 15516 | 15538 | CCCTAGCCAACCCCTTAAACACC | 2499 | GGTGTTTAAGGGGTTGGCTA | 4268 |
| 15517 | 15539 | CCTAGCCAACCCCTTAAACACCC | 2500 | GGGTGTTTAAGGGGTTGGCT | 4269 |
| 15522 | 15544 | CCAACCCCTTAAACACCCTCCC | 2501 | GGGAGGGGTGTTTAAGGGGT | 4270 |
| 15526 | 15548 | CCCCTTAAACACCCCTCCCACA | 2502 | TGTGGGGAGGGGTGTTTAAG | 4271 |
| 15527 | 15549 | CCCTTAAACACCCCTCCCACAT | 2503 | ATGTGGGGAGGGGTGTTTAA | 4272 |
| 15528 | 15550 | CCTTAAACACCCCTCCCCACATC | 2504 | GATGTGGGGAGGGGTGTTTA | 4273 |
| 15537 | 15559 | CCCCTCCCCACATCAAGCCCGAA | 2505 | TTCGGGCTTGATGTGGGGAG | 4274 |
| 15538 | 15560 | CCCTCCCCACATCAAGCCCGAAT | 2506 | ATTCGGGCTTGATGTGGGGA | 4275 |
| 15539 | 15561 | CCTCCCCACATCAAGCCCGAATG | 2507 | CATTCGGGCTTGATGTGGGG | 4276 |
| 15542 | 15564 | CCCCACATCAAGCCCGAATGATA | 2508 | TATCATTCGGGCTTGATGTG | 4277 |
| 15543 | 15565 | CCCACATCAAGCCCGAATGATAT | 2509 | ATATCATTCGGGCTTGATGT | 4278 |
| 15544 | 15566 | CCACATCAAGCCCGAATGATATT | 2510 | AATATCATTCGGGCTTGATG | 4279 |
| 15554 | 15576 | CCCGAATGATATTTCCTATTCGC | 2511 | GCGAATAGGAAATATCATTC | 4280 |
| 15555 | 15577 | CCGAATGATATTTCCTATTCGCC | 2512 | GGCGAATAGGAAATATCATT | 4281 |
| 15568 | 15590 | CCTATTCGCCTACACAATTCTCC | 2513 | GGAGAATTGTGTAGGCGAAT | 4282 |
| 15576 | 15598 | CCTACACAATTCTCCGATCCGTC | 2514 | GACGGATCGGAGAATTGTGT | 4283 |
| 15589 | 15611 | CCGATCCGTCCCTAACAAACTAG | 2515 | CTAGTTTGTTAGGGACGGAT | 4284 |
| 15594 | 15616 | CCGTCCCTAACAAACTAGGAGGC | 2516 | GCCTCCTAGTTTGTTAGGGA | 4285 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 15598 | 15620 | CCCTAACAAACTAGGAGGCGTCC | 2517 | GGACGCCTCCTAGTTTGTTA | 4286 |
| 15599 | 15621 | CCTAACAAACTAGGAGGCGTCCT | 2518 | AGGACGCCTCCTAGTTTGTT | 4287 |
| 15619 | 15641 | CCTTGCCCTATTACTATCCATCC | 2519 | GGATGGATAGTAATAGGGCA | 4288 |
| 15624 | 15646 | CCCTATTACTATCCATCCTCATC | 2520 | GATGAGGATGGATAGTAATA | 4289 |
| 15625 | 15647 | CCTATTACTATCCATCCTCATCC | 2521 | GGATGAGGATGGATAGTAAT | 4290 |
| 15636 | 15658 | CCATCCTCATCCTAGCAATAATC | 2522 | GATTATTGCTAGGATGAGGA | 4291 |
| 15640 | 15662 | CCTCATCCTAGCAATAATCCCCA | 2523 | TGGGGATTATTGCTAGGATG | 4292 |
| 15646 | 15668 | CCTAGCAATAATCCCCATCCTCC | 2524 | GGAGGATGGGGATTATTGCT | 4293 |
| 15658 | 15680 | CCCCATCCTCCATATATCCAAAC | 2525 | GTTTGGATATATGGAGGATG | 4294 |
| 15659 | 15681 | CCCATCCTCCATATATCCAAACA | 2526 | TGTTTGGATATATGGAGGAT | 4295 |
| 15660 | 15682 | CCATCCTCCATATATCCAAACAA | 2527 | TTGTTTGGATATATGGAGGA | 4296 |
| 15664 | 15686 | CCTCCATATATCCAAACAACAAA | 2528 | TTTGTTGTTTGGATATATGG | 4297 |
| 15667 | 15689 | CCATATATCCAAACAACAAAGCA | 2529 | TGCTTTGTTGTTTGGATATA | 4298 |
| 15675 | 15697 | CCAAACAACAAAGCATAATATTT | 2530 | AAATATTATGCTTTGTTGTT | 4299 |
| 15700 | 15722 | CCCACTAAGCCAATCACTTTATT | 2531 | AATAAAGTGATTGGCTTAGT | 4300 |
| 15701 | 15723 | CCACTAAGCCAATCACTTTATTG | 2532 | CAATAAAGTGATTGGCTTAG | 4301 |
| 15709 | 15731 | CCAATCACTTTATTGACTCCTAG | 2533 | CTAGGAGTCAATAAAGTGAT | 4302 |
| 15727 | 15749 | CCTAGCCGCAGACCTCCTCATTC | 2534 | GAATGAGGAGGTCTGCGGCT | 4303 |
| 15732 | 15754 | CCGCAGACCTCCTCATTCTAACC | 2535 | GGTTAGAATGAGGAGGTCTG | 4304 |
| 15739 | 15761 | CCTCCTCATTCTAACCTGAATCG | 2536 | CGATTCAGGTTAGAATGAGG | 4305 |
| 15742 | 15764 | CCTCATTCTAACCTGAATCGGAG | 2537 | CTCCGATTCAGGTTAGAATG | 4306 |
| 15753 | 15775 | CCTGAATCGGAGGACAACCAGTA | 2538 | TACTGGTTGTCCTCCGATTC | 4307 |
| 15770 | 15792 | CCAGTAAGCTACCCTTTTACCAT | 2539 | ATGGTAAAAGGGTAGCTTAC | 4308 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 15781 | 15803 | CCCTTTTACCATCATTGGACAAG | 2540 | CTTGTCCAATGATGGTAAAA | 4309 |
| 15782 | 15804 | CCTTTTACCATCATTGGACAAGT | 2541 | ACTTGTCCAATGATGGTAAA | 4310 |
| 15789 | 15811 | CCATCATTGGACAAGTAGCATCC | 2542 | GGATGCTACTTGTCCAATGA | 4311 |
| 15810 | 15832 | CCGTACTATACTTCACAACAATC | 2543 | GATTGTTGTGAAGTATAGTA | 4312 |
| 15832 | 15854 | CCTAATCCTAATACCAACTATCT | 2544 | AGATAGTTGGTATTAGGATT | 4313 |
| 15838 | 15860 | CCTAATACCAACTATCTCCCTAA | 2545 | TTAGGGAGATAGTTGGTATT | 4314 |
| 15845 | 15867 | CCAACTATCTCCCTAATGAAAA | 2546 | TTTTCAATTAGGGAGATAGT | 4315 |
| 15855 | 15877 | CCCTAATTGAAAACAAAATACTC | 2547 | GAGTATTTTGTTTTCAATTA | 4316 |
| 15856 | 15878 | CCTAATTGAAAACAAAATACTCA | 2548 | TGAGTATTTTGTTTTCAATT | 4317 |
| 15885 | 15907 | CCTGTCCTTGTAGTATAAACTAA | 2549 | TTAGTTTATACTACAAGGAC | 4318 |
| 15890 | 15912 | CCTTGTAGTATAAACTAATACAC | 2550 | GTGTATTAGTTTATACTACA | 4319 |
| 15912 | 15934 | CCAGTCTTGTAAACCGGAGATGA | 2551 | TCATCTCCGGTTTACAAGAC | 4320 |
| 15925 | 15947 | CCGGAGATGAAAACCTTTTTCCA | 2552 | TGGAAAAAGGTTTTCATCTC | 4321 |
| 15938 | 15960 | CCTTTTTCCAAGGACAAATCAGA | 2553 | TCTGATTTGTCCTTGGAAAA | 4322 |
| 15945 | 15967 | CCAAGGACAAATCAGAGAAAAAG | 2554 | CTTTTTCTCTGATTTGTCCT | 4323 |
| 15977 | 15999 | CCACCATTAGCACCCAAAGCTAA | 2555 | TTAGCTTTGGGTGCTAATGG | 4324 |
| 15980 | 16002 | CCATTAGCACCCAAAGCTAAGAT | 2556 | ATCTTAGCTTTGGGTGCTAA | 4325 |
| 15989 | 16011 | CCCAAAGCTAAGATTCTAATTTA | 2557 | TAAATTAGAATCTTAGCTTT | 4326 |
| 15990 | 16012 | CCAAAGCTAAGATTCTAATTTAA | 2558 | TTAAATTAGAATCTTAGCTT | 4327 |
| 16052 | 16074 | CCACCCAAGTATTGACTCACCCA | 2559 | TGGGTGAGTCAATACTTGGG | 4328 |
| 16055 | 16077 | CCCAAGTATTGACTCACCCATCA | 2560 | TGATGGGTGAGTCAATACTT | 4329 |
| 16056 | 16078 | CCAAGTATTGACTCACCCATCAA | 2561 | TTGATGGGTGAGTCAATACT | 4330 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 16071 | 16093 | CCCATCAACAACCGCTATGTATT | 2562 | AATACATAGCGGTTGTTGAT | 4331 |
| 16072 | 16094 | CCATCAACAACCGCTATGTATTT | 2563 | AAATACATAGCGGTTGTTGA | 4332 |
| 16082 | 16104 | CCGCTATGTATTTCGTACATTAC | 2564 | GTAATGTACGAAATACATAG | 4333 |
| 16107 | 16129 | CCAGCCACCATGAATATTGTACG | 2565 | CGTACAATATTCATGGTGGC | 4334 |
| 16111 | 16133 | CCACCATGAATATTGTACGGTAC | 2566 | GTACCGTACAATATTCATGG | 4335 |
| 16114 | 16136 | CCATGAATATTGTACGGTACCAT | 2567 | ATGGTACCGTACAATATTCA | 4336 |
| 16133 | 16155 | CCATAAATACTTGACCACCTGTA | 2568 | TACAGGTGGTCAAGTATTTA | 4337 |
| 16147 | 16169 | CCACCTGTAGTACATAAAAACCC | 2569 | GGGTTTTTATGTACTACAGG | 4338 |
| 16150 | 16172 | CCTGTAGTACATAAAAACCCAAT | 2570 | ATTGGGTTTTTATGTACTAC | 4339 |
| 16167 | 16189 | CCCAATCCACATCAAAACCCCCT | 2571 | AGGGGGTTTTGATGTGGATT | 4340 |
| 16168 | 16190 | CCAATCCACATCAAAACCCCCTC | 2572 | GAGGGGGTTTTGATGTGGAT | 4341 |
| 16173 | 16195 | CCACATCAAAACCCCCTCCCCAT | 2573 | ATGGGGAGGGGGTTTTGATG | 4342 |
| 16184 | 16206 | CCCCCTCCCCATGCTTACAAGCA | 2574 | TGCTTGTAAGCATGGGGAGG | 4343 |
| 16185 | 16207 | CCCCTCCCCATGCTTACAAGCAA | 2575 | TTGCTTGTAAGCATGGGGAG | 4344 |
| 16186 | 16208 | CCCTCCCCATGCTTACAAGCAAG | 2576 | CTTGCTTGTAAGCATGGGGA | 4345 |
| 16187 | 16209 | CCTCCCCATGCTTACAAGCAAGT | 2577 | ACTTGCTTGTAAGCATGGGG | 4346 |
| 16190 | 16212 | CCCCATGCTTACAAGCAAGTACA | 2578 | TGTACTTGCTTGTAAGCATG | 4347 |
| 16191 | 16213 | CCCATGCTTACAAGCAAGTACAG | 2579 | CTGTACTTGCTTGTAAGCAT | 4348 |
| 16192 | 16214 | CCATGCTTACAAGCAAGTACAGC | 2580 | GCTGTACTTGCTTGTAAGCA | 4349 |
| 16221 | 16243 | CCCTCAACTATCACACATCAACT | 2581 | AGTTGATGTGTGATAGTTGA | 4350 |
| 16222 | 16244 | CCTCAACTATCACACATCAACTG | 2582 | CAGTTGATGTGTGATAGTTG | 4351 |
| 16250 | 16272 | CCAAAGCCACCCCTCACCCACTA | 2583 | TAGTGGGTGAGGGGTGGCTT | 4352 |
| 16256 | 16278 | CCACCCCTCACCCACTAGGATAC | 2584 | GTATCCTAGTGGGTGAGGGG | 4353 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 16259 | 16281 | CCCCTCACCCACTAGGATACCAA | 2585 | TTGGTATCCTAGTGGGTGAG | 4354 |
| 16260 | 16282 | CCCTCACCCACTAGGATACCAAC | 2586 | GTTGGTATCCTAGTGGGTGA | 4355 |
| 16261 | 16283 | CCTCACCCACTAGGATACCAACA | 2587 | TGTTGGTATCCTAGTGGGTG | 4356 |
| 16266 | 16288 | CCCACTAGGATACCAACAAACCT | 2588 | AGGTTTGTTGGTATCCTAGT | 4357 |
| 16267 | 16289 | CCACTAGGATACCAACAAACCTA | 2589 | TAGGTTTGTTGGTATCCTAG | 4358 |
| 16278 | 16300 | CCAACAAACCTACCCACCCTTAA | 2590 | TTAAGGGTGGGTAGGTTTGT | 4359 |
| 16286 | 16308 | CCTACCCACCCTTAACAGTACAT | 2591 | ATGTACTGTTAAGGGTGGGT | 4360 |
| 16290 | 16312 | CCCACCCTTAACAGTACATAGTA | 2592 | TACTATGTACTGTTAAGGGT | 4361 |
| 16291 | 16313 | CCACCCTTAACAGTACATAGTAC | 2593 | GTACTATGTACTGTTAAGGG | 4362 |
| 16294 | 16316 | CCCTTAACAGTACATAGTACATA | 2594 | TATGTACTATGTACTGTTAA | 4363 |
| 16295 | 16317 | CCTTAACAGTACATAGTACATAA | 2595 | TTATGTACTATGTACTGTTA | 4364 |
| 16320 | 16342 | CCATTTACCGTACATAGCACATT | 2596 | AATGTGCTATGTACGGTAAA | 4365 |
| 16327 | 16349 | CCGTACATAGCACATTACAGTCA | 2597 | TGACTGTAATGTGCTATGTA | 4366 |
| 16353 | 16375 | CCCTTCTCGTCCCCATGGATGAC | 2598 | GTCATCCATGGGGACGAGAA | 4367 |
| 16354 | 16376 | CCTTCTCGTCCCCATGGATGACC | 2599 | GGTCATCCATGGGGACGAGA | 4368 |
| 16363 | 16385 | CCCCATGGATGACCCCCCTCAGA | 2600 | TCTGAGGGGGGTCATCCATG | 4369 |
| 16364 | 16386 | CCCATGGATGACCCCCCTCAGAT | 2601 | ATCTGAGGGGGGTCATCCAT | 4370 |
| 16365 | 16387 | CCATGGATGACCCCCCTCAGATA | 2602 | TATCTGAGGGGGGTCATCCA | 4371 |
| 16375 | 16397 | CCCCCTCAGATAGGGGTCCCTT | 2603 | AAGGGACCCCTATCTGAGGG | 4372 |
| 16376 | 16398 | CCCCCTCAGATAGGGGTCCCTTG | 2604 | CAAGGGACCCCTATCTGAGG | 4373 |
| 16377 | 16399 | CCCCTCAGATAGGGGTCCCTTGA | 2605 | TCAAGGGACCCCTATCTGAG | 4374 |
| 16378 | 16400 | CCCTCAGATAGGGGTCCCTTGAC | 2606 | GTCAAGGGACCCCTATCTGA | 4375 |

TABLE 4-continued gRNA target sequence for human mtDNA carrying NGG sequence on the (-) strand.

| Chr start position (+ strand) | Chr end position (+ strand) | nt sequence on the (+) strand containing CCN sequence followed by the reverse complementary sequence of gRNA target sequence | SEQ ID NO | 20 nt gRNA target sequence (will encode the gRNA targeting sequence) | SEQ ID NO |
|---|---|---|---|---|---|
| 16379 | 16401 | CCTCAGATAGGGGTCCCTTGACC | 2607 | GGTCAAGGGACCCCTATCTG | 4376 |
| 16393 | 16415 | CCCTTGACCACCATCCTCCGTGA | 2608 | TCACGGAGGATGGTGGTCAA | 4377 |
| 16394 | 16416 | CCTTGACCACCATCCTCCGTGAA | 2609 | TTCACGGAGGATGGTGGTCA | 4378 |
| 16400 | 16422 | CCACCATCCTCCGTGAAATCAAT | 2610 | ATTGATTTCACGGAGGATGG | 4379 |
| 16403 | 16425 | CCATCCTCCGTGAAATCAATATC | 2611 | GATATTGATTTCACGGAGGA | 4380 |
| 16407 | 16429 | CCTCCGTGAAATCAATATCCCGC | 2612 | GCGGGATATTGATTTCACGG | 4381 |
| 16410 | 16432 | CCGTGAAATCAATATCCCGCACA | 2613 | TGTGCGGGATATTGATTTCA | 4382 |
| 16425 | 16447 | CCCGCACAAGAGTGCTACTCTCC | 2614 | GGAGAGTAGCACTCTTGTGC | 4383 |
| 16426 | 16448 | CCGCACAAGAGTGCTACTCTCCT | 2615 | AGGAGAGTAGCACTCTTGTG | 4384 |
| 16446 | 16468 | CCTCGCTCCGGGCCCATAACACT | 2616 | AGTGTTATGGGCCCGGAGCG | 4385 |
| 16453 | 16475 | CCGGGCCCATAACACTTGGGGGT | 2617 | ACCCCCAAGTGTTATGGGCC | 4386 |
| 16458 | 16480 | CCCATAACACTTGGGGGTAGCTA | 2618 | TAGCTACCCCCAAGTGTTAT | 4387 |
| 16459 | 16481 | CCATAACACTTGGGGGTAGCTAA | 2619 | TTAGCTACCCCCAAGTGTTA | 4388 |
| 16494 | 16516 | CCGACATCTGGTTCCTACTTCAG | 2620 | CTGAAGTAGGAACCAGATGT | 4389 |
| 16507 | 16529 | CCTACTTCAGGGTCATAAAGCCT | 2621 | AGGCTTTATGACCCTGAAGT | 4390 |
| 16527 | 16549 | CCTAAATAGCCCACACGTTCCCC | 2622 | GGGGAACGTGTGGGCTATTT | 4391 |
| 16536 | 16558 | CCCACACGTTCCCCTTAAATAAG | 2623 | CTTATTTAAGGGGAACGTGT | 4392 |
| 16537 | 16559 | CCACACGTTCCCCTTAAATAAGA | 2624 | TCTTATTTAAGGGGAACGTG | 4393 |
| 16546 | 16568 | CCCCTTAAATAAGACATCACGAT | 2625 | ATCGTGATGTCTTATTTAAG | 4394 |
| 16547 | 16569 | CCCTTAAATAAGACATCACGATG | 2626 | CATCGTGATGTCTTATTTAA | 4395 |
| 16548 | 16570 | CCTTAAATAAGACATCACGATGG | 2627 | CCATCGTGATGTCTTATTTA | 4396 |

Applications

The gNAs (e.g., gRNAs) and collections of gNAs (e.g., gRNAs) provided herein are useful for a variety of applications, including depletion, partitioning, capture, or enrichment of target sequences of interest; genome-wide labeling; genome-wide editing; genome-wide function screens; and genome-wide regulation.

In one embodiment, the gNAs are selective for host nucleic acids in a biological sample from a host, but are not selective for non-host nucleic acids in the sample from a host. In one embodiment, the gNAs are selective for non-host nucleic acids from a biological sample from a host but are not selective for the host nucleic acids in the sample. In one embodiment, the gNAs are selective for both host nucleic acids and a subset of the non-host nucleic acids in a biological sample from a host. For example, where a complex biological sample comprises host nucleic acids and nucleic acids from more than one non-host organisms, the gRNAs may be selective for more than one of the non-host species. In such embodiments, the gNAs are used to serially deplete or partition the sequences that are not of interest. For example, saliva from a human contains human DNA, as well as the DNA of more than one bacterial species, but may also contain the genomic material of an unknown pathogenic organism. In such an embodiment, gNAs directed at the human DNA and the known bacteria can be used to serially deplete the human DNA, and the DNA of the known bacterial, thus resulting in a sample comprising the genomic material of the unknown pathogenic organism.

In an exemplary embodiment, the gNAs are selective for human host DNA obtained from a biological sample from the host, but do not hybridize with DNA from an unknown pathogen(s) also obtained from the sample.

In some embodiments, the gNAs are useful for depleting and partitioning of targeted sequences in a sample, enriching a sample for non-host nucleic acids, or serially depleting targeted nucleic acids in a sample comprising: providing nucleic acids extracted from a sample; and contacting the sample with a plurality of complexes comprising (i) any one of the collection of gNAs described herein and (ii) nucleic acid-guided nuclease (e.g., CRISPR/Cas) system proteins.

In some embodiments, the gNAs are useful for method of depletion and partitioning of targeted sequences in a sample comprising: providing nucleic acids extracted from a sample, wherein the extracted nucleic acids comprise sequences of interest and targeted sequences for one of depletion and partitioning; contacting the sample with a plurality of complexes comprising (i) a collection of gNAs provided herein; and (ii) nucleic acid-guided nuclease (e.g., CRISPR/Cas) system proteins, under conditions in which the nucleic acid-guided nuclease system proteins cleave the nucleic acids in the sample.

In some embodiments, the gNAs are useful for enriching a sample for non-host nucleic acids comprising: providing a sample comprising host nucleic acids and non-host nucleic acids; contacting the sample with a plurality of complexes comprising (i) a collection of gNAs provided herein comprising targeting sequences directed at the host nucleic acids; and (ii) nucleic acid-guided nuclease (e.g., CRISPR/Cas) system proteins, under conditions in which the nucleic acid-guided nuclease system proteins cleave the host nucleic acids in the sample, thereby depleting the sample of host nucleic acids, and allowing for the enrichment of non-host nucleic acids.

In some embodiments, the gNAs are useful for one method for serially depleting targeted nucleic acids in a sample comprising: providing a biological sample from a host comprising host nucleic acids and non-host nucleic acids, wherein the non-host nucleic acids comprise nucleic acids from at least one known non-host organism and nucleic acids from an unknown non-host organism; providing a plurality of complexes comprising (i) a collection of gNAs provided herein, directed at the host nucleic acids; and (ii) nucleic acid-guided nuclease (e.g., CRISPR/Cas) system proteins; mixing the nucleic acids from the biological sample with the gNA-nucleic acid-guided nuclease system protein complexes (e.g., gRNA-CRISPR/Cas system protein complexes) configured to hybridize to targeted sequences in the host nucleic acids, wherein at least a portion of the complexes hybridizes to the targeted sequences in the host nucleic acids, and wherein at least a portion of the host nucleic acids are cleaved; mixing the remaining nucleic acids from the biological sample with the gNA-nucleic acid-guided nuclease system protein complexes configured to hybridize to targeted sequences in the at least one known non-host nucleic acids, wherein at least a portion of the complexes hybridizes to the targeted sequences in the at least one non-host nucleic acids, and wherein at least a portion of the non-host nucleic acids are cleaved; and isolating the remaining nucleic acids from the unknown non-host organism and preparing for further analysis.

In some embodiments, the gNAs generated herein are used to perform genome-wide or targeted functional screens in a population of cells. In such an embodiment, libraries of in vitro-transcribed gNAs (e.g., gRNAs) or vectors encoding the gNAs can be introduced into a population of cells via transfection or other laboratory techniques known in the art, along with a nucleic acid-guided nuclease (e.g., CRISPR/Cas) system protein, in a way that gNA-directed nucleic acid-guided nuclease system protein editing can be achieved to sequences across the entire genome or to a specific region of the genome. In one embodiment, the nucleic acid-guided nuclease system protein can be introduced as a DNA. In one embodiment, the nucleic acid-guided nuclease system protein can be introduced as mRNA. In one embodiment, the nucleic acid-guided nuclease system protein can be introduced as protein. In one exemplary embodiment, the nucleic acid-guided nuclease system protein is Cas9.

In some embodiments, the gNAs generated herein are used for the selective capture and/or enrichment of nucleic acid sequences of interest. For example, in some embodiments, the gNAs generated herein are used for capturing target nucleic acid sequences comprising: providing a sample comprising a plurality of nucleic acids; and contacting the sample with a plurality of complexes comprising (i) a collection of gNAs provided herein; and (ii) nucleic acid-guided nuclease (e.g., CRISPR/Cas) system proteins. Once the sequences of interest are captured, they can be further ligated to create, for example, a sequencing library.

In some embodiments, the gNAs generated herein are used for introducing labeled nucleotides at targeted sites of interest comprising: (a) providing a sample comprising a plurality of nucleic acid fragments; (b) contacting the sample with a plurality of complexes comprising (i) a collection of gNAs provided herein; and (ii) nucleic acid-guided nuclease (e.g., CRISPR/Cas) system protein-nickases (e.g. Cas9-nickases), wherein the gNAs are complementary to targeted sites of interest in the nucleic acid fragments, thereby generating a plurality of nicked nucleic acid fragments at the targeted sites of interest; and (c) contacting the plurality of nicked nucleic acid fragments with an enzyme capable of initiating nucleic acid synthesis at a nicked site, and labeled nucleotides, thereby generating a plurality of nucleic acid fragments comprising labeled nucleotides in the targeted sites of interest.

In some embodiments, the gNAs generated herein are used for capturing target nucleic acid sequences of interest comprising: (a) providing a sample comprising a plurality of adapter-ligated nucleic acids, wherein the nucleic acids are ligated to a first adapter at one end and are ligated to a second adapter at the other end; and (b) contacting the sample with a collection of gNAs which comprise a plurality of dead nucleic acid-guided nuclease-gNA complexes (e.g., dCas9-gRNA complexes), wherein the dead nucleic acid-guided nuclease (e.g., dCas9) is fused to a transposase, wherein the gNAs are complementary to targeted sites of interest contained in a subset of the nucleic acids, and wherein the dead nucleic acid-guided nuclease-gNA transposase complexes (e.g., dCas9-gRNA transposase complexes) are loaded with a plurality of third adapters, to generate a plurality of nucleic acids fragments comprising either a first or second adapter at one end and a third adapter at the other end. In one embodiment the method further comprises amplifying the product of step (b) using first or second adapter and third adapter-specific PCR.

In some embodiments, the gNAs generated herein are used to perform genome-wide or targeted activation or repression in a population of cells. In such an embodiment, libraries of in vitro-transcribed gNAs (e.g., gRNAs) or vectors encoding the gNAs can be introduced into a population of cells via transfection or other laboratory techniques known in the art, along with a catalytically dead nucleic acid-guided nuclease (e.g., CRISPR/Cas) system protein fused to an activator or repressor domain (catalytically dead nucleic acid-guided nuclease system protein-fusion protein), in a way that gNA-directed catalytically dead nucleic acid-guided nuclease system protein-mediated activation or repression can be achieved at sequences across the entire genome or to a specific region of the genome. In one embodiment, the catalytically dead nucleic acid-guided nuclease system protein-fusion protein can be introduced as DNA. In one embodiment, the catalytically dead nucleic acid-guided nuclease system protein-fusion protein can be introduced as mRNA. In one embodiment, the catalytically dead nucleic acid-guided nuclease system protein-fusion protein can be introduced as protein. In some embodiments, the collection of gNAs or nucleic acids encoding for gNAs exhibit specificity for more than one nucleic acid-guided nuclease system protein. In one exemplary embodiment, the catalytically dead nucleic acid-guided nuclease system protein is dCas9.

In some embodiments, the collection comprises gRNAs or nucleic acids encoding for gRNAs with specificity for Cas9 and one or more CRISPR/Cas system proteins selected from selected from the group consisting of Cpf1, Cas3, Cas8a-c, Cas10, Cse1, Csy1, Csn2, Cas4, Csm2, and Cm5. In some embodiments, the collection comprises gRNAs or nucleic acids encoding for gRNAs with specificity for various catalytically dead CRISPR/Cas system proteins fused to different fluorophores, for example for use in the labeling and/or visualization of different genomes or portions of genomes, for use in the labeling and/or visualization of different chromosomal regions, or for use in the labeling and/or visualization of the integration of viral genes/genomes into a genome.

In some embodiments, the collection of gNAs (or nucleic acids encoding for gNAs) have specificity for different nucleic acid-guided nuclease (e.g., CRISPR/Cas) system proteins, and target different sequences of interest, for example from different species. For example, a first subset of gNAs from a collection of gNAs (or transcribed from a population of nucleic acids encoding such gNAs) targeting a genome from a first species can be first mixed with a first nucleic acid-guided nuclease system protein member (or an engineered version); and a second subset of gNAs from a collection of gNAs (or transcribed from a population of nucleic acids encoding such gNAs) targeting a genome from a second species can be mixed with a second different nucleic acid-guided nuclease system protein member (or an engineered version). In one embodiment, the nucleic acid-guided nuclease system proteins can be a catalytically dead version (for example dCas9) fused with different fluorophores, so that different targeted sequence of interest, e.g. different species genome, or different chromosomes of one species, can be labeled by different fluorescent labels. For example, different chromosomal regions can be labeled by different gRNA-targeted dCas9-fluorophores, for visualization of genetic translocations. For example, different viral genomes can be labeled by different gRNA-targeted dCas9-fluorophores, for visualization of integration of different viral genomes into the host genome. In another embodiment, the nucleic acid-guided nuclease system protein can be dCas9 fused with either activation or repression domain, so that different targeted sequence of interest, e.g. different chromosomes of a genome, can be differentially regulated. In another embodiment, the nucleic acid-guided nuclease system protein can be dCas9 fused different protein domain which can be recognized by different antibodies, so that different targeted sequence of interest, e.g. different DNA sequences within a sample mixture, can be differentially isolated.

Exemplary Compositions of the Invention

In one embodiment, provided herein is a composition comprising a nucleic acid fragment, a nickase nucleic acid-guided nuclease-gNA complex, and labeled nucleotides. In one exemplary embodiment, provided herein is a composition comprising a nucleic acid fragment, a nickase Cas9-gRNA complex, and labeled nucleotides. In such embodiments, the nucleic acid may comprise DNA. The nucleotides can be labeled, for example with biotin. The nucleotides can be part of an antibody-conjugate pair.

In one embodiment, provided herein is a composition comprising a nucleic acid fragment and a catalytically dead nucleic acid-guided nuclease-gNA complex, wherein the catalytically dead nucleic acid-guided nuclease is fused to a transposase. In one exemplary embodiment, provided herein is a composition comprising a DNA fragment and a dCas9-gRNA complex, wherein the dCas9 is fused to a transposase.

In one embodiment, provided herein is a composition comprising a nucleic acid fragment comprising methylated nucleotides, a nickase nucleic acid-guided nuclease-gNA complex, and unmethylated nucleotides. In an exemplary embodiment, provided herein is a composition comprising a DNA fragment comprising methylated nucleotides, a nickase Cas9-gRNA complex, and unmethylated nucleotides.

In one embodiment, provided herein is a gDNA complexed with a nucleic acid-guided-DNA endonuclease. In an exemplary embodiment, the nucleic acid-guided-DNA endonuclease is NgAgo.

In one embodiment, provided herein is a gDNA complexed with a nucleic acid-guided-RNA endonuclease.

In one embodiment, provided herein is a gRNA complexed with a nucleic acid-guided-DNA endonuclease.

In one embodiment, provided herein is a gRNA complexed with a nucleic acid-guided-RNA endonuclease. In one embodiment, the nucleic acid-guided-RNA endonuclease comprises C2c2.

Kits and Articles of Manufacture

The present application provides kits comprising any one or more of the compositions described herein, not limited to adapters, gNAs (e.g., gRNAs), gNA collections (e.g., gRNA collections), nucleic acid molecules encoding the gNA collections, and the like.

In one exemplary embodiment, the kit comprises a collection of DNA molecules capable of transcribing into a library of gRNAs wherein the gRNAs are targeted to human genomic or other sources of DNA sequences.

In one embodiment, the kit comprises a collection of gNAs wherein the gNAs are targeted to human genomic or other sources of DNA sequences.

In some embodiments, provided herein are kits comprising any of the collection of nucleic acids encoding gNAs, as described herein. In some embodiments, provided herein are kits comprising any of the collection of gNAs, as described herein.

The present application also provides all essential reagents and instructions for carrying out the methods of making the gNAs and the collection of nucleic acids encoding gNAs, as described herein. In some embodiments, provided herein are kits that comprise all essential reagents and instructions for carrying out the methods of making individual gNAs and collections of gNAs as described herein.

Also provided herein is computer software monitoring the information before and after contacting a sample with a gNA collection produced herein. In one exemplary embodiment, the software can compute and report the abundance of non-target sequence in the sample before and after providing gNA collection to ensure no off-target targeting occurs, and wherein the software can check the efficacy of targeted-depletion/encrichment/capture/partitioning/labeling/regulation/editing by comparing the abundance of the target sequence before and after providing gNA collection to the sample.

The following examples are included for illustrative purposes and are not intend to limit the scope of the invention.

EXAMPLES

Example 1: Construction of a gRNA Library from a T7 Promoter Human DNA Library

T7 Promoter Library Construction

Human genomic DNA (400 ng) was fragmented using an S2 Covaris sonicator (Covaris) for 8 cycles, to yield fragments of 200-300 bp in length. Fragmented DNA was repaired using the NEBNext End Repair Module (NEB) and incubated at 25° C. for 30 min, then heat inactivated at 75° C. for 20 min. To make T7 promoter adapters, oligos T7-1 (5'GCCTCGAGC*T*A*ATACGACTCACTATAGAG3', * denotes a phosphorothioate backbone linkage)(SEQ ID NO: 4397) and T7-2 (sequence 5'Phos-CTCTATAGTGAGTCG-TATTA3') (SEQ ID NO: 4398) were admixed at 15 µM, heated to 98° C. for 3 min then cooled slowly (0.1° C./min) to 30° C. T7 promoter blunt adapters (15 pmol total) were then added to the blunt-ended human genomic DNA fragments, and incubated with Blunt/TA Ligase Master Mix (NEB) at 25° C. for 30 min ((2) in FIG. 1). Ligations were amplified with 2 µM oligo T7-1, using Hi-Fidelity 2× Master Mix (NEB) for 10 cycles of PCR (98° C. for 20 s, 63° C. for 20 s, 72° C. for 35 s). Amplification was verified by running a small aliquot on agarose gel electrophoresis. PCR amplified products were recovered using 0.6× AxyPrep beads (Axygen) according to the manufacturer's instructions, and resuspended in 15 µL of 10 mM Tris-HCl pH 8.

Digestion of DNA

PCR amplified T7 promoter DNA (2 µg total per digestion) was digested with 0.1 µL of Nt.CviPII (NEB) in 10 µL of NEB buffer 2 (50 mM NaCl, 10 mM Tris-HCl pH 7.9, 10 mM MgCl$_2$, 100 µg/mL BSA) for 10 min at 37° C. ((3) in FIG. 1), then heat inactivated at 75° C. for 20 min. An additional 10 µL of NEB buffer 2 with 1 µL of T7 Endonuclease I (NEB) was added to the reaction, and incubated at 37° C. for 20 min ((4) in FIG. 1). Enzymatic digestion of DNA was verified by agarose gel electrophoresis. Digested DNA was recovered by adding 0.6× AxyPrep beads (Axygen), according to the manufacturer's instructions, and resuspended in 15 µL of 10 mM Tris-HCl pH 8.

Ligation of Adapters and Removal of HGG

DNA was then blunted using T4 DNA Polymerase (NEB) for 20 min at 25° C., followed by heat inactivation at 75° C. for 20 min ((5) in FIG. 1).

To make MlyI adapters, oligos MlyI-1 (sequence 5'>3', 5'Phos-GGGACTCGGATCCCTATAGTGATA-CAAAGACGATGACGACAAGCG) (SEQ ID NO: 4399) and MlyI-2 (sequence 5'>3', TCACTATAGGGATC-CGAGTCCC) (SEQ ID NO: 4400) were admixed at 15 µM, heated to 98° C. for 3 min then cooled slowly (0.1° C./min) to 30° C. MlyI adapters (15 pmol total) were then added to T4 DNA Polymerase-blunted DNA, and incubated with Blunt/TA Ligase Master Mix (NEB) at 25° C. for 30 min ((6) in FIG. 1). Ligations were heat inactivated at 75° C. for 20 min, then digested with MlyI and XhoI (NEB) for 1 hr at 37° C., so that HGG motifs are eliminated ((7) in FIG. 1). Digests were then cleaned using 0.8× AxyPrep beads (Axygen), and DNA was resuspended in 10 µL of 10 mM Tris-Cl pH 8.

To make StlgR adapters, oligos stlgR (sequence 5'>3', 5'Phos-GTTTTAGAGCTAGAAATAGCAAGT-TAAAATAAGGCTAGTCCGTTATCAACTT-GAAAAAGTGGCACCG AGTCGGTGCTTTTTTTG-GATCCGATGC) (SEQ ID NO: 4401) and stlgRev (sequence 5'>3', GGATCCAAAAAAAGCACCGACTCG-GTGCCACTTTTTCAAGTTGATAACGGACTAGCCTT-ATTTTAAC TTGCTATTTCTAGCTCTAAAAC) (SEQ ID NO: 4402) were admixed at 15 µM, heated to 98° C. for 3 min then cooled slowly (0.1° C./min) to 60° C. StlgR adapters (5 pmol total) were added to HGG-removed DNA fragments, and incubated with Blunt/TA Ligase Master Mix (NEB) at 25° C. for 30 min ((8) in FIG. 1). Ligations were then incubated with Hi-Fidelity 2× Master Mix (NEB), using 2 µM of both oligos T7-1 and gRU (sequence 5'>3', AAAAAAAGCACCGACTCGGTG) (SEQ ID NO: 4403), and amplified using 20 cycles of PCR (98° C. for 20 s, 60° C. for 20 s, 72° C. for 35 s). Amplification was verified by running a small aliquot on agarose gel electrophoresis. PCR amplified products were recovered using 0.6× AxyPrep beads (Axygen) according to the manufacturer's instructions, and resuspended in 15 µL of 10 mM Tris-HCl pH 8.

In Vitro Transcription

The T7/gRU amplified library of PCR products was then used as template for in vitro transcription, using the HiScribe T7 In Vitro Transcription Kit (NEB). 500-1000 ng of template was incubated overnight at 37° C. according to the manufacturer's instructions. To transcribe the guide libraries into gRNAs, the following in vitro transcription reaction mixture was assembled: 10 µL of purified library (~500 ng), 6.5 µL of H$_2$O, 2.25 µL of ATP, 2.25 µL of CTP, 2.25 µL of GTP, 2.25 µL of UTP, 2.25 µL of 10× reaction buffer (NEB) and 2.25 µL of T7 RNA Polymerase mix. The reaction was incubated at 37° C. for 24 hr, then purified using the RNA cleanup kit (Life Technologies), eluted with 100 µL of RNase-free water, quantified and stored at −20° C. until use.

Example 2: Construction of gRNA Library from Intact Human Genomic DNA

Digestion of DNA

Human genomic DNA ((1) in FIG. 2; 20 µg total per digestion) was digested with 0.1 µL of Nt.CviPII (NEB) in 40 µL of NEB buffer 2 (50 mM NaCl, 10 mM Tris-HCl pH 7.9, 10 mM MgCl$_2$, 100 µg/mL BSA) for 10 min at 37° C., then heat inactivated at 75° C. for 20 min. An additional 40 µL of NEB buffer 2 and 1 µL of T7 Endonuclease I (NEB) was added to the reaction, with 20 min incubation at 37° C. (e.g., (2) in FIG. 2). Fragmentation of genomic DNA was verified with a small aliquot by agarose gel electrophoresis. DNA fragments between 200 and 600 bp were recovered by adding 0.3× AxyPrep beads (Axygen), incubating at 25° C. for 5 min, capturing beads on a magnetic stand and transferring the supernatant to a new tube. DNA fragments below 600 bp do not bind to beads at this bead/DNA ratio and remain in the supernatant. 0.7× AxyPrep beads (Axygen) were then added to the supernatant (this will bind all DNA molecules longer than 200 bp), allowed to bind for 5 min. Beads were captured on a magnetic stand and washed twice with 80% ethanol, air dried. DNA was then resuspended in 15 µL of 10 mM Tris-HCl pH 8. DNA concentration was determined using a Qbit assay (Life Technologies).

Ligation of Adapters

To make T7/MlyI adapters, oligos MlyI-1 (sequence 5'>3', 5'Phos-GGGGGACTCGGATCCCTATAGTGATA-CAAAGACGATGACGACAAGCG) (SEQ ID NO: 4404) and T7-7 (sequence 5'>3', GCCTCGAGC*T*A*ATACGACTCACTATAGGGATCCAAGTCCC, * denotes a phosphorothioate backbone linkage) (SEQ ID NO: 4405) were admixed at 15 µM, heated to 98° C. for 3 min then cooled slowly (0.1° C./min) to 30° C. The purified, Nt.CviPII/T7 Endonuclease I digested DNA (100 ng) was then ligated to 15 pmol of T7/MlyI adapters using Blunt/TA Ligase Master Mix (NEB) at 25° C. for 30 min ((3) in FIG. 2). Ligations were then amplified by 10 cycles of PCR (98° C. for 20 s, 60° C. for 20 s, 72° C. for 35 s) using Hi-Fidelity 2× Master Mix (NEB), and 2 µM of both oligos T7-17 (GCCTCGAGC*T*A*ATACGACTCACTATAGGG * denotes a phosphorothioate backbone linkage) (SEQ ID NO: 4406) and Flag (sequence 5'>3', CGCTTGTCGTCATCGTCTTTGTA) (SEQ ID NO: 4407). PCR amplification increases the yield of DNA and, given the nature of the Y-shaped adapters we used, always resulted in T7 promoter being added distal to the HGG site and MlyI site being added next to the HGG motif ((4) in FIG. 2).

PCR products were then digested with MlyI and XhoI (NEB) for 1 hr at 37° C., and heat inactivated at 75° C. for 20 min ((5) in FIG. 2). Following that, 5 pmol of adapter StlgR (in Example 1) was ligated using Blunt/TA Ligase Master Mix (NEB) at 25° C. for 30 min ((6) in FIG. 2). Ligations were then amplified by PCR using Hi-Fidelity 2× Master Mix (NEB), 2 µM of both oligos T7-7 and gRU (in Example 1) and 20 cycles of PCR (98° C. for 20 s, 60° C. for 20 s, 72° C. for 35 s). Amplification was verified by running a small aliquot on agarose gel electrophoresis. PCR amplified products were recovered using 0.6× AxyPrep beads (Axygen) according to the manufacturer's instructions, and resuspended in 15 µL of 10 mM Tris-HCl pH 8.

Samples were then used as templates for in vitro transcription reaction as described in Example 1.

Example 3: Direct Cutting with CviPII

30 µg of human genomic DNA was digested with 2 units of NtCviPII (New England Biolabs) for 1 hour at 37° C., followed by heat inactivation at 75° C. for 20 minutes. The size of the fragments was verified to be 200-1,000 base pairs using a fragment analyzer instrument (Advanced Analytical). The 5' or 3' protruding ends (as shown, for example, in FIG. 3) were converted to blunt ends by adding 100 units of T4 DNA polymerase (New England Biolabs), 100 µM dNTPs and incubating at 12° C. for 30 minutes. DNA was then recovered using a PCR cleanup kit (Zymo) and eluted in 20 µL elution buffer. The DNA was then ligated to MlyI adapter (see, for example, Example 4) or BaeI/EcoP15I adapters (see, for example, Example 4) or BaeI/EcoP15I adapters (see, for example, Example 5)

Example 4: Use of MlyI Adapter

Adapter MlyI was made by combining 2 µmoles of MlyI Ad1 and MlyAd2 in 40 µL water. Adapter BsaXI/MmeI was made by combining 2 moles oligo BsMm-Ad1 and 2 moles oligo BsMm-Ad2 in 40 µL water. T7 adapter was made by combining 1.5 µmoles of T7-Ad1 and T7-Ad2 oligos in 100 µL water. Stem-loop adapter was made by combining 1.5 µmoles of gR-top and gR-bot oligos in 100 µL water. In all cases, after mixing adapters were heated to 98° C. for 3 min then cooled to room temperature at a cooling rate of 1° C./min in a thermal cycler.

TABLE 5

Oligonucleotides used with MlyI Adapter.

| SEQ ID NO | Oligo name | Sequence (5' > 3') | Modification |
|---|---|---|---|
| 4408 | MlyI-Ad1 | gagatcagcttctgcattgatgccagcagcccgagtcag | none |
| 4409 | MlyI-Ad2 | ctgactcgggctgctgtacaaagacgatgacgacaagcgtta | 5'phosphate |
| 4410 | BsMm-Ad1 | gagatcagcttctgcattgatgcGGAGCCGCAGTACACTATCCAAC | none |
| 4411 | BsMm-Ad2 | GTTGGATAGTGTACTGCGGCTCCtacaaagacgatgacgacaagcg | 5'phosphate |
| 4412 | T7-Ad1 | gcctcgagctaatacgactcactatagagNN | none |

TABLE 5-continued

Oligonucleotides used with MlyI Adapter.

| SEQ ID NO | Oligo name | Sequence (5' > 3') | Modification |
|---|---|---|---|
| 4398 | T7-Ad2 | Ctctatagtgagtcgtatta | 5'phosphate |
| 4413 | gR-top | ttagagctagaaatagcaagttaaaataaggctagtccgttatcaa cttgaaaaagtggcaccgatcggtgcttttt | 5'phosphate |
| 4414 | gR-bot | aaaaaagcaccgactcggtgccactttttcaagttgataacggact agccttattttaacttgctatttctagctctaaaac | none |

The DNA containing the CCD blunt ends (from earlier section) was then ligated to 50 pmoles of adapter MlyI, using the blunt/TA ligation master mix (New England Biolabs) at room temperature for 30 minutes. The DNA was then recovered by incubating with 0.6× Kapa SPRI beads (Kapa Biosystems) for 5 minutes, capturing the beads with a magnetic rack, washing twice with 80% ethanol, air drying the beads for 5 minutes and finally resuspending the DNA in 50 µL buffer 4 (50 mM potassium acetate, 20 mM Tris-acetate, 10 mM magnesium acetate, 100 µg/mL BSA, pH 7.9). These steps eliminate small (<100 nucleotides) DNA and MlyI adapter dimers.

Purified DNA was then digested by adding 20 units of MlyI (New England Biolabs) and incubating at 37° C. for 1 hour to eliminate both the adapter derived sequences and the CCD (and complementary HGG) motifs. DNA was recovered from the digest by incubating with 0.6× Kapa SPRI beads (Kapa Biosystems) for 5 minutes, capturing the beads with a magnetic rack, washing twice with 80% ethanol, air drying the beads for 5 minutes and finally resuspending the DNA in 30 µL buffer 4.

The purified DNA was then ligated to 50 pmoles of adapter BsaXI/MmeI, using the blunt/TA ligation master mix (New England Biolabs) at room temperature for 30 minutes. The DNA was then recovered by incubating with 0.6× Kapa SPRI beads (Kapa Biosystems) for 5 minutes, capturing the beads with a magnetic rack, washing twice with 80% ethanol, air drying the beads for 5 minutes and finally resuspending the DNA in 50 µL buffer 4 (50 mM potassium acetate, 20 mM Tris-acetate, 10 mM magnesium acetate, 100 µg/mL BSA, pH 7.9). DNA was then digested by addition of 20 units MmeI (New England Biolabs) and 40 pmol/µL SAM (S-adenosyl methionine) at 37° C. for 1 hour, followed by heat inactivation at 75° C. for 20 minutes. DNA was then ligated to 30 pmoles T7 adapter using the blunt/TA ligation master mix (New England Biolabs) at room temperature for 30 minutes. DNA was then recovered using a PCR cleanup kit (Zymo) and eluted in 20 µL buffer 4, then digested with 20 units of BsaXI for 1 hour at 37° C. The guide RNA stem-loop sequences were added by adding 15 pmoles stem-loop adapter and using the blunt/TA ligation master mix (New England Biolabs) at room temperature for 30 min. DNA was then recovered using a PCR cleanup kit (Zymo), eluted in 20 µL elution buffer and PCR amplified using HiFidelity 2× master mix (New England Biolabs). Primers T7-Ad1 and gRU (sequence 5'>3' AAAAAAGCACCGACTCGGTG) (SEQ ID NO: 4419) were used to amplify with the following settings (98° C. 3 min; 98° C. for 20 sec, 60° C. for 30 secs, 72° C. for 20 sec, 30 cycles). The PCR amplicon was cleaned up using the PCR cleanup kit and verified by DNA sequencing, then used as template for an in vitro transcription reaction to generate guide RNAs.

Example 5: Use of BaeI/EcoP15I Adapter

Adapter BaeI/EcoP15I was made by combining 2 moles of BE Ad1 and BE Ad2 in 40 µL water. T7-E adapter was made by combining 1.5 µmoles of T7-Ad3 and T7-Ad4 oligos in 100 µL water. In all cases, after mixing adapters were heated to 98° C. for 3 min then cooled to room temperature at a cooling rate of 1° C./min in a thermal cycler.

TABLE 6

Oligonucleotides used with BaeI/EcoP15I Adapter.

| SEQ ID NO: | Oligo name | Sequence (5 > 3) | Modification |
|---|---|---|---|
| 4416 | BE Ad1 | ActgctgacACAAgtatcTTTTTTTTTTgtttaaacTTTTTTTTTT gatacACAAgtcagcagA | 5'phosphate |
| 4416 | Be Ad2 | TctgctgacTTGTgtatcAAAAAAAAAAgtttaaacAAAAAAAAAA gatacTTGTgtcagcagT | 5'phosphate |
| 12 | T7-Ade | gcctcgagctaatacgactcactatagag | none |
| 4417 | T7-Ad4 | NNctctatagtgagtcgtatta | 5'phosphate |
| 4418 | stIgR | ttagagctagaaatagcaagttaaaataaggctagtccgttatcaa cttgaaaaagtggcaccgagtcggtgcttttt | 5'adenylation |

The DNA containing the CCD blunt ends (from earlier section) was then ligated to 50 pmoles of adapter BaeI/EcoP15I, using the blunt/TA ligation master mix (New England Biolabs) at room temperature for 30 minutes. The DNA was then recovered by incubating with 0.6× Kapa SPRI beads (Kapa Biosystems) for 5 minutes, capturing the beads with a magnetic rack, washing twice with 80% ethanol, air drying the beads for 5 minutes and finally resuspending the DNA in 50 µL buffer 4 (50 mM potassium acetate 20 mM Tris-acetate, 10 mM magnesium acetate, 100 µg/mL BSA, pH 7.9). Recovered DNA was then digested with 20 units PmeI for 30 min at 37° C.; DNA was then recovered by incubating with 1.2× Kapa SPRI beads (Kapa Biosystems) for 5 minutes, capturing the beads with a magnetic rack, washing twice with 80% ethanol, air drying the beads for 5 minutes and finally resuspending the DNA in 50 µL buffer 4. These steps eliminate small (<100 nucleotides) DNA and BaeI/EcoP15I adapter multimers.

DNA was then digested by addition of 20 units EcoP15I (New England Biolabs) and 1 mM ATP at 37° C. for 1 hour, followed by heat inactivation at 75° C. for 20 minutes. DNA was then ligated to 30 pmoles T7-E adapter using the blunt/TA ligation master mix (New England Biolabs) at room temperature for 30 minutes. DNA was then recovered using a PCR cleanup kit (Zymo) and eluted in 20 µL buffer 4.

Purified DNA was then digested by adding 20 units of BaeI (New England Biolabs), 40 pmol/µL SAM (S-adenosyl methionine) and incubating at 37° C. for 1 hour to eliminate both the adapter derived sequences and the CCD (and complementary HGG) motifs. DNA was then recovered using a PCR cleanup kit (Zymo) and eluted in 20 µL elution buffer.

Recovered DNA was then ligated to the stlgR oligo using Thermostable 5' AppDNA/RNA Ligase (New England Biolabs) by adding 20 units ligase, 20 pmol stlgR oligo, in 20 µL ss ligation buffer (10 mM Bis-Tris-Propane-HCl, 10 mM MgCl$_2$, 1 mM DTT, 2.5 mM MnCl$_2$, pH 7 @ 25° C.) and incubating at 65° C. for 1 hour followed by heat inactivation at 90° C. for 5 min. DNA product was then PCR amplified using HiFidelity 2× master mix (New England Biolabs). Primers T7-Ad3 and gRU (sequence 5'>3' AAAAAAGCACCGACTCGGTG) (SEQ ID NO: 4419) were used to amplify with the following settings (98° C. 3 min; 98° C. for 20 sec, 60° C. for 30 secs, 72° C. for 20 sec, 30 cycles). The PCR amplicon was cleaned up using the PCR cleanup kit and verified by DNA sequencing, then used as template for an in vitro transcription reaction to generate the guide RNAs.

Example 6: NEMDA Method

NEMDA (Nicking Endonuclease Mediated DNA Amplification) was performed using 50 ng of human genomic DNA. The DNA was incubated in 100 µL thermo polymerase buffer (20 mM Tris-HCl, 10 mM (NH$_4$)$_2$SO$_4$, 10 mM KCl, 6 mM MgSO$_4$, 0.1% Triton® X-100, pH 8.8) supplemented with 0.3 mM dNTPs, 40 units of Bst large fragment DNA polymerase, and 0.1 units of NtCviPII (New England Biolabs) at 55° C. for 45 min, followed by 65° C. for 30 min and finally 80° C. for 20 min in a thermal cycler.

The DNA was then diluted with 300 µL of buffer 4 supplemented with 200 pmoles of T7-RND8 oligo (sequence 5'>3' gcctcgagctaatacgactcactatagagnnnnnnnn) (SEQ ID NO: 4420) and boiled at 98° C. for 10 min followed by rapid cooling to 10° C. for 5 min. The reaction was then supplemented with 40 units of *E. coli* DNA polymerase I and 0.1 mM dNTPs (New England Biolabs) and incubated at room temperature for 20 min followed by heat inactivation at 75° C. for 20 min. DNA was then recovered using a PCR cleanup kit (Zymo) and eluted in 30 µL elution buffer.

DNA was then ligated to 50 pmoles of adapter BaeI/EcoP15I, using the blunt/TA ligation master mix (New England Biolabs) at room temperature for 30 minutes. The DNA was then recovered by incubating with 0.6× Kapa SPRI beads (Kapa Biosystems) for 5 minutes, capturing the beads with a magnetic rack, washing twice with 80% ethanol, air drying the beads for 5 minutes and finally resuspending the DNA in 50 µL buffer 4 (50 mM potassium acetate, 20 mM Tris-acetate, 10 mM magnesium acetate, 100 µg/mL BSA, pH 7.9). Recovered DNA was then digested with 20 units PmeI for 30 min at 37° C.; DNA was then recovered by incubating with 1.2× Kapa SPRI beads (Kapa Biosystems) for 5 minutes, capturing the beads with a magnetic rack, washing twice with 80% ethanol, air drying the beads for 5 minutes and finally resuspending the DNA in 50 µL buffer 4. These steps eliminate small (<100 nucleotides) DNA and BaeI/EcoP15I adapter multimers.

Purified DNA was then digested by adding 20 units of BaeI (New England Biolabs), 40 pmol/µL SAM (S-adenosyl methionine) and incubating at 37° C. for 1 hour to eliminate both the adapter derived sequences and the CCD (and complementary HGG) motifs. DNA was then recovered using a PCR cleanup kit (Zymo) and eluted in 20 µL elution buffer.

Recovered DNA was then ligated to the stlgR oligo using Thermostable 5' AppDNA/RNA Ligase (New England Biolabs) by adding 20 units ligase, 20 pmol stlgR oligo, in 20 µL ss ligation buffer (10 mM Bis-Tris-Propane-HCl, 10 mM MgCl$_2$, 1 mM DTT, 2.5 mM MnCl$_2$, pH 7 @ 25° C.) and incubating at 65° C. for 1 hour followed by heat inactivation at 90° C. for 5 min. DNA product was then PCR amplified using HiFidelity 2× master mix (New England Biolabs). Primers T7-Ad3 (sequence 5'>3' gcctcgagctaatacgactcactatagag) (SEQ ID NO: 12) and gRU (sequence 5'>3' AAAAAAGCACCGACTCGGTG) (SEQ ID NO: 4419) were used to amplify with the following settings (98° C. for 3 min; 98° C. for 20 sec, 60° C. for 30 secs, 72° C. for 20 sec, 30 cycles). The PCR amplicon was cleaned up using the PCR cleanup kit and verified by DNA sequencing, then used as template for an in vitro transcription reaction to generate the guide RNAs.

SEQUENCE LISTING (4430 sequences)

SEQ ID NO: 1 - RNA, 83 nt, Artificial Sequence
  gRNA stem-loop sequence
guuuuagagcuagaaauagcaaguuaaaauaaggcuaguccguuaucaacuugaaaaaguggcaccgagucggugcuuuuuuu

SEQ ID NO: 2 - RNA, 94 nt, Artificial Sequence
  gRNA stem-loop sequence
guuuuagagcuaugcuggaaacagcauagcaaguuaaaauaaggcuaguccguuaucaacuugaaaaaguggcaccgagucggugcuuuuuuuc

SEQ ID NO: 3 - DNA, 83 bp, Artificial Sequence
  Stem-loop sequence
gttttagagctagaaatagcaagttaaaataaggctagtccgttatcaacttgaaaaagtggcaccgagtcggtgcttttttt

SEQ ID NO: 4 - DNA, 83 bp, Artificial Sequence
  Stem-loop sequence
aaaaaaagcaccgactcggtgccactttttcaagttgataacggactagccttattttaacttgctatttctagctctaaaac

SEQ ID NO: 5 - DNA, 94 bp, Artificial Sequence
  Stem-loop sequence
gttttagagctatgctggaaacagcatagcaagttaaaataaggctagtccgttatcaacttgaaaaagtggcaccgagtcggtgctttttttc

SEQ ID NO: 6 - DNA, 94 bp, Artificial Sequence
  Stem-loop sequence
gaaaaaaagcaccgactcggtgccactttttcaagttgataacggactagccttattttaacttgctatgctgtttccagcatagctctaaaac

SEQ ID NO: 7 - DNA, 272 bp, Artificial Sequence
  crRNA
  misc_feature (1)..(250): n is a, c, g, or t
  misc_feature (16)..(250): each individual n may be present or absent
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttagagctatgctgttttg

SEQ ID NO: 8 - DNA, 86 bp, Artificial Sequence
  tracrRNA
ggaaccattcaaaacagcatagcaagttaaaataaggctagtccgttatcaacttgaaaaagtggcaccgagtcggtgcttttttt

SEQ ID NO: 9 - DNA, 22 bp, Artificial Sequence
  crRNA
gttttagagctatgctgttttg

SEQ ID NO: 10 - DNA, 22 bp, Artificial Sequence
  crRNA
caaaacagcatagctctaaaac

SEQ ID NO: 11 - RNA, 86 nt, Artificial Sequence
  tracrRNA
ggaaccauucaaaacagcauagcaaguuaaaauaaggcuaguccguuaucaacuugaaaaaguggcaccgagucggugcuuuuuuu

SEQ ID NO: 12 - DNA, 29 bp, Artificial Sequence
  T7-Ad3
gcctcgagctaatacgactcactatagag

SEQ ID NO: 13 - DNA, 23 bp, Artificial Sequence
  gRNA target sequence
atcaccctattaaccactcacgg

SEQ ID NO: 14 - DNA, 23 bp, Artificial Sequence
  gRNA target sequence
tcaccctattaaccactcacggg

SEQ ID NO: 15 - DNA, 23 bp, Artificial Sequence
  gRNA target sequence
acgggagctctccatgcatttgg

SEQ ID NO: 16 - DNA, 23 bp, Artificial Sequence
  gRNA target sequence
atgcatttggtattttcgtctgg

SEQ ID NO: 17 - DNA, 23 bp, Artificial Sequence
  gRNA target sequence
tgcatttggtattttcgtctggg

SEQ ID NO: 18 - DNA, 23 bp, Artificial Sequence
  gRNA target sequence
gcatttggtattttcgtctgggg

SEQ ID NO: 19 - DNA, 23 bp, Artificial Sequence
  gRNA target sequence
catttggtattttcgtctggggg

SEQ ID NO: 20 - DNA, 23 bp, Artificial Sequence
  gRNA target sequence
atttggtattttcgtctgggggg

SEQ ID NO: 21 - DNA, 23 bp, Artificial Sequence
  gRNA target sequence
gcgatagcattgcgagacgctgg

SEQ ID NO: 22 - DNA, 23 bp, Artificial Sequence
  gRNA target sequence
gcattgcgagacgctggagccgg

SEQ ID NO: 23 - DNA, 23 bp, Artificial Sequence
  gRNA target sequence
gcacctacgttcaatattacagg

SEQ ID NO: 24 - DNA, 23 bp, Artificial Sequence
  gRNA target sequence
gttaattaattaatgcttgtagg

SEQ ID NO: 25 - DNA, 23 bp, Artificial Sequence
  gRNA target sequence
aaccccccctcccccgcttctgg

SEQ ID NO: 26 - DNA, 23 bp, Artificial Sequence
  gRNA target sequence
agatttcaaattttatcttttgg

SEQ ID NO: 27 - DNA, 23 bp, Artificial Sequence
  gRNA target sequence
tttcaaattttatcttttggcgg

SEQ ID NO: 28 - DNA, 23 bp, Artificial Sequence
  gRNA target sequence
atacactgaaaatgtttagacgg

SEQ ID NO: 29 - DNA, 23 bp, Artificial Sequence
  gRNA target sequence
tacactgaaaatgtttagacggg

SEQ ID NO: 30 - DNA, 23 bp, Artificial Sequence
  gRNA target sequence
acatcaccccataaacaaatagg

SEQ ID NO: 31 - DNA, 23 bp, Artificial Sequence
  gRNA target sequence
accccataaacaaataggtttgg

SEQ ID NO: 32 - DNA, 23 bp, Artificial Sequence
  gRNA target sequence
tctaaatcaccacgatcaaaagg

SEQ ID NO: 33 - DNA, 23 bp, Artificial Sequence
  gRNA target sequence
ttagcctagccacacccccacgg

SEQ ID NO: 34 - DNA, 23 bp, Artificial Sequence
  gRNA target sequence
tagcctagccacacccccacggg

SEQ ID NO: 35 - DNA, 23 bp, Artificial Sequence
  gRNA target sequence
aactaagctatactaaccccagg

SEQ ID NO: 36 - DNA, 23 bp, Artificial Sequence
  gRNA target sequence
actaagctatactaaccccaggg

SEQ ID NO: 37 - DNA, 23 bp, Artificial Sequence
  gRNA target sequence
agctatactaaccccagggttgg

SEQ ID NO: 38 - DNA, 23 bp, Artificial Sequence
  gRNA target sequence
caatttcgtgccagccaccgcgg

SEQ ID NO: 39 - DNA, 23 bp, Artificial Sequence
  gRNA target sequence
taacccaagtcaatagaagccgg

SEQ ID NO: 40 - DNA, 23 bp, Artificial Sequence
  gRNA target sequence
cacaaaatagactacgaaagtgg

SEQ ID NO: 41 - DNA, 23 bp, Artificial Sequence
  gRNA target sequence
acaatagctaagacccaaactgg

SEQ ID NO: 42 - DNA, 23 bp, Artificial Sequence
  gRNA target sequence
caatagctaagacccaaactggg

SEQ ID NO: 43 - DNA, 23 bp, Artificial Sequence
  gRNA target sequence
agccacagcttaaaactcaaagg

SEQ ID NO: 44 - DNA, 23 bp, Artificial Sequence
  gRNA target sequence
agcttaaaactcaaaggacctgg

SEQ ID NO: 45 - DNA, 23 bp, Artificial Sequence
  gRNA target sequence
ttaaaactcaaaggacctggcgg

SEQ ID NO: 46 - DNA, 23 bp, Artificial Sequence
  gRNA target sequence
ggtgcttcatatccctctagagg

SEQ ID NO: 47 - DNA, 23 bp, Artificial Sequence
  gRNA target sequence
tcttcagcaaaccctgatgaagg

SEQ ID NO: 48 - DNA, 23 bp, Artificial Sequence
  gRNA target sequence
agtacccacgtaaagacgttagg

SEQ ID NO: 49 - DNA, 23 bp, Artificial Sequence
  gRNA target sequence
cacgtaaagacgttaggtcaagg

SEQ ID NO: 50 - DNA, 23 bp, Artificial Sequence
  gRNA target sequence
aggtcaaggtgtagcccatgagg

SEQ ID NO: 51 - DNA, 23 bp, Artificial Sequence
  gRNA target sequence
tcaaggtgtagcccatgaggtgg

SEQ ID NO: 52 - DNA, 23 bp, Artificial Sequence
  gRNA target sequence
gcccatgaggtggcaagaaatgg

SEQ ID NO: 53 - DNA, 23 bp, Artificial Sequence
  gRNA target sequence
cccatgaggtggcaagaaatggg

SEQ ID NO: 54 - DNA, 23 bp, Artificial Sequence
  gRNA target sequence
gatagcccttatgaaacttaagg

SEQ ID NO: 55 - DNA, 23 bp, Artificial Sequence
  gRNA target sequence
atagcccttatgaaacttaaggg

SEQ ID NO: 56 - DNA, 23 bp, Artificial Sequence
  gRNA target sequence
ttatgaaacttaagggtcgaagg

SEQ ID NO: 57 - DNA, 23 bp, Artificial Sequence
  gRNA target sequence
tgaaacttaagggtcgaaggtgg

SEQ ID NO: 58 - DNA, 23 bp, Artificial Sequence
  gRNA target sequence
agtagagtgcttagttgaacagg

SEQ ID NO: 59 - DNA, 23 bp, Artificial Sequence
  gRNA target sequence
gtagagtgcttagttgaacaggg

SEQ ID NO: 60 - DNA, 23 bp, Artificial Sequence
  gRNA target sequence
cctcctcaagtatacttcaaagg

SEQ ID NO: 61 - DNA, 23 bp, Artificial Sequence
  gRNA target sequence
acccctacgcatttatatagagg

SEQ ID NO: 62 - DNA, 23 bp, Artificial Sequence
  gRNA target sequence
agaggagacaagtcgtaacatgg

SEQ ID NO: 63 - DNA, 23 bp, Artificial Sequence
  gRNA target sequence
tcgtaacatggtaagtgtactgg

SEQ ID NO: 64 - DNA, 23 bp, Artificial Sequence
  gRNA target sequence
agtgtactggaaagtgcacttgg

SEQ ID NO: 65 - DNA, 23 bp, Artificial Sequence
  gRNA target sequence
aaagcacccaacttacacttagg

SEQ ID NO: 66 - DNA, 23 bp, Artificial Sequence
  gRNA target sequence
catttacccaaataaagtatagg

SEQ ID NO: 67 - DNA, 23 bp, Artificial Sequence
  gRNA target sequence
aggcgatagaaattgaaacctgg

SEQ ID NO: 68 - DNA, 23 bp, Artificial Sequence
  gRNA target sequence
gcaatagatatagtaccgcaagg

SEQ ID NO: 69 - DNA, 23 bp, Artificial Sequence
  gRNA target sequence
caatagatatagtaccgcaaggg

SEQ ID NO: 70 - DNA, 23 bp, Artificial Sequence
  gRNA target sequence
taaccaagcataatatagcaagg

SEQ ID NO: 71 - DNA, 23 bp, Artificial Sequence
  gRNA target sequence
taactagaaataactttgcaagg

SEQ ID NO: 72 - DNA, 23 bp, Artificial Sequence
  gRNA target sequence
ccgtctatgtagcaaaatagtgg

SEQ ID NO: 73 - DNA, 23 bp, Artificial Sequence
  gRNA target sequence
cgtctatgtagcaaaatagtggg

SEQ ID NO: 74 - DNA, 23 bp, Artificial Sequence
  gRNA target sequence
aaaatagtgggaagatttatagg

SEQ ID NO: 75 - DNA, 23 bp, Artificial Sequence
  gRNA target sequence
gtgggaagatttataggtagagg

SEQ ID NO: 76 - DNA, 23 bp, Artificial Sequence
  gRNA target sequence
ggcgacaaacctaccgagcctgg

SEQ ID NO: 77 - DNA, 23 bp, Artificial Sequence
  gRNA target sequence
ctaccgagcctggtgatagctgg

SEQ ID NO: 78 - DNA, 23 bp, Artificial Sequence
  gRNA target sequence
atttaactgttagtccaaagagg

SEQ ID NO: 79 - DNA, 23 bp, Artificial Sequence
  gRNA target sequence
tccaaagaggaacagctctttgg

SEQ ID NO: 80 - DNA, 23 bp, Artificial Sequence
  gRNA target sequence
ggaacagctctttggacactagg

SEQ ID NO: 81 - DNA, 23 bp, Artificial Sequence
  gRNA target sequence
aaaaatttaacacccatagtagg

SEQ ID NO: 82 - DNA, 23 bp, Artificial Sequence
  gRNA target sequence
ctgaactcctcacacccaattgg

SEQ ID NO: 83 - DNA, 23 bp, Artificial Sequence
  gRNA target sequence
cctcactgtcaacccaacacagg

SEQ ID NO: 84 - DNA, 23 bp, Artificial Sequence
  gRNA target sequence
ccaacacaggcatgctcataagg

SEQ ID NO: 85 - DNA, 23 bp, Artificial Sequence
  gRNA target sequence
acaggcatgctcataaggaaagg

SEQ ID NO: 86 - DNA, 23 bp, Artificial Sequence
  gRNA target sequence
gaaaggttaaaaaaagtaaaagg

SEQ ID NO: 87 - DNA, 23 bp, Artificial Sequence
  gRNA target sequence
taaaaaaagtaaaaggaactcgg

SEQ ID NO: 88 - DNA, 23 bp, Artificial Sequence
  gRNA target sequence
tctagcatcaccagtattagagg

SEQ ID NO: 89 - DNA, 23 bp, Artificial Sequence
  gRNA target sequence
gcccagtgacacatgtttaacgg

SEQ ID NO: 90 - DNA, 23 bp, Artificial Sequence
  gRNA target sequence
tgacacatgtttaacggccgcgg

SEQ ID NO: 91 - DNA, 23 bp, Artificial Sequence
  gRNA target sequence
gcggtaccctaaccgtgcaaagg

SEQ ID NO: 92 - DNA, 23 bp, Artificial Sequence
  gRNA target sequence
taatcacttgttccttaaatagg

SEQ ID NO: 93 - DNA, 23 bp, Artificial Sequence
  gRNA target sequence
aatcacttgttccttaaataggg

SEQ ID NO: 94 - DNA, 23 bp, Artificial Sequence
  gRNA target sequence
taaatagggacctgtatgaatgg

SEQ ID NO: 95 - DNA, 23 bp, Artificial Sequence
  gRNA target sequence
cctgtatgaatggctccacgagg

SEQ ID NO: 96 - DNA, 23 bp, Artificial Sequence
  gRNA target sequence
ctgtatgaatggctccacgaggg

SEQ ID NO: 97 - DNA, 23 bp, Artificial Sequence
  gRNA target sequence
aaattgacctgcccgtgaagagg

SEQ ID NO: 98 - DNA, 23 bp, Artificial Sequence
  gRNA target sequence
ttgacctgcccgtgaagaggcgg

SEQ ID NO: 99 - DNA, 23 bp, Artificial Sequence
  gRNA target sequence
tgacctgcccgtgaagaggcggg

SEQ ID NO: 100 - DNA, 23 bp, Artificial Sequence
  gRNA target sequence
agcaagacgagaagaccctatgg

SEQ ID NO: 101 - DNA, 23 bp, Artificial Sequence
  gRNA target sequence
acagtacctaacaaacccacagg

SEQ ID NO: 102 - DNA, 23 bp, Artificial Sequence
  gRNA target sequence
caaacctgcattaaaaatttcgg

SEQ ID NO: 103 - DNA, 23 bp, Artificial Sequence
  gRNA target sequence
cctgcattaaaaatttcggttgg

SEQ ID NO: 104 - DNA, 23 bp, Artificial Sequence
  gRNA target sequence
ctgcattaaaaatttcggttggg

SEQ ID NO: 105 - DNA, 23 bp, Artificial Sequence
  gRNA target sequence
tgcattaaaaatttcggttgggg

SEQ ID NO: 106 - DNA, 23 bp, Artificial Sequence
  gRNA target sequence
aatttcggttggggcgacctcgg

SEQ ID NO: 107 - DNA, 23 bp, Artificial Sequence
  gRNA target sequence
tgatccaataacttgaccaacgg

SEQ ID NO: 108 - DNA, 23 bp, Artificial Sequence
  gRNA target sequence
ccaacggaacaagttaccctagg

SEQ ID NO: 109 - DNA, 23 bp, Artificial Sequence
  gRNA target sequence
caacggaacaagttaccctaggg

SEQ ID NO: 110 - DNA, 23 bp, Artificial Sequence
  gRNA target sequence
ctagagtccatatcaacaatagg

SEQ ID NO: 111 - DNA, 23 bp, Artificial Sequence
  gRNA target sequence
tagagtccatatcaacaataggg

SEQ ID NO: 112 - DNA, 23 bp, Artificial Sequence
  gRNA target sequence
agggtttacgacctcgatgttgg

SEQ ID NO: 113 - DNA, 23 bp, Artificial Sequence
  gRNA target sequence
tacgacctcgatgttggatcagg

SEQ ID NO: 114 - DNA, 23 bp, Artificial Sequence
  gRNA target sequence
gttggatcaggacatcccgatgg

SEQ ID NO: 115 - DNA, 23 bp, Artificial Sequence
  gRNA target sequence
gatggtgcagccgctattaaagg

SEQ ID NO: 116 - DNA, 23 bp, Artificial Sequence
  gRNA target sequence
tacgtgatctgagttcagaccgg

SEQ ID NO: 117 - DNA, 23 bp, Artificial Sequence
  gRNA target sequence
agttcagaccggagtaatccagg

SEQ ID NO: 118 - DNA, 23 bp, Artificial Sequence
  gRNA target sequence
cagaccggagtaatccaggtcgg

SEQ ID NO: 119 - DNA, 23 bp, Artificial Sequence
  gRNA target sequence
caaattcctccctgtacgaaagg

SEQ ID NO: 120 - DNA, 23 bp, Artificial Sequence
  gRNA target sequence
acgaaaggacaagagaaataagg

SEQ ID NO: 121 - DNA, 23 bp, Artificial Sequence
  gRNA target sequence
acccacacccacccaagaacagg

SEQ ID NO: 122 - DNA, 23 bp, Artificial Sequence
  gRNA target sequence
cccacacccacccaagaacaggg

SEQ ID NO: 123 - DNA, 23 bp, Artificial Sequence
  gRNA target sequence
aagaacagggtttgttaagatgg

SEQ ID NO: 124 - DNA, 23 bp, Artificial Sequence
  gRNA target sequence
tttgttaagatggcagagcccgg

SEQ ID NO: 125 - DNA, 23 bp, Artificial Sequence
  gRNA target sequence
acttaaaactttacagtcagagg

SEQ ID NO: 126 - DNA, 23 bp, Artificial Sequence
  gRNA target sequence
tcttcttaacaacatacccatgg

SEQ ID NO: 127 - DNA, 23 bp, Artificial Sequence
  gRNA target sequence
tgtacccattctaatcgcaatgg

SEQ ID NO: 128 - DNA, 23 bp, Artificial Sequence
  gRNA target sequence
cttaccgaacgaaaaattctagg

SEQ ID NO: 129 - DNA, 23 bp, Artificial Sequence
  gRNA target sequence
ggctatatacaactacgcaaagg

SEQ ID NO: 130 - DNA, 23 bp, Artificial Sequence
  gRNA target sequence
cgcaaaggccccaacgttgtagg

SEQ ID NO: 131 - DNA, 23 bp, Artificial Sequence
  gRNA target sequence
cccaacgttgtaggcccctacgg

SEQ ID NO: 132 - DNA, 23 bp, Artificial Sequence
  gRNA target sequence
ccaacgttgtaggcccctacggg

SEQ ID NO: 133 - DNA, 23 bp, Artificial Sequence
  gRNA target sequence
cctccccatacccaaccccctgg

SEQ ID NO: 134 - DNA, 23 bp, Artificial Sequence
  gRNA target sequence
cccctggtcaacctcaacctagg

SEQ ID NO: 135 - DNA, 23 bp, Artificial Sequence
  gRNA target sequence
gtttactcaatcctctgatcagg

SEQ ID NO: 136 - DNA, 23 bp, Artificial Sequence
  gRNA target sequence
tttactcaatcctctgatcaggg

SEQ ID NO: 137 - DNA, 23 bp, Artificial Sequence
  gRNA target sequence
aactcaaactacgccctgatcgg

SEQ ID NO: 138 - DNA, 23 bp, Artificial Sequence
  gRNA target sequence
ctatcaacattactaataagtgg

SEQ ID NO: 139 - DNA, 23 bp, Artificial Sequence
  gRNA target sequence
actcctgccatcatgacccttgg

SEQ ID NO: 140 - DNA, 23 bp, Artificial Sequence
  gRNA target sequence
acccccttcgaccttgccgaagg

SEQ ID NO: 141 - DNA, 23 bp, Artificial Sequence
  gRNA target sequence
cccccttcgaccttgccgaaggg

SEQ ID NO: 142 - DNA, 23 bp, Artificial Sequence
  gRNA target sequence
ccccttcgaccttgccgaagggg

SEQ ID NO: 143 - DNA, 23 bp, Artificial Sequence
  gRNA target sequence
ggggagtccgaactagtctcagg

SEQ ID NO: 144 - DNA, 23 bp, Artificial Sequence
  gRNA target sequence
ttcaacatcgaatacgccgcagg

SEQ ID NO: 145 - DNA, 23 bp, Artificial Sequence
  gRNA target sequence
ctcaccactacaatcttcctagg

SEQ ID NO: 146 - DNA, 23 bp, Artificial Sequence
  gRNA target sequence
actttgatagagtaaataatagg

SEQ ID NO: 147 - DNA, 23 bp, Artificial Sequence
  gRNA target sequence
gcttaaacccccttatttctagg

SEQ ID NO: 148 - DNA, 23 bp, Artificial Sequence
  gRNA target sequence
tcacaccccatcctaaagtaagg

SEQ ID NO: 149 - DNA, 23 bp, Artificial Sequence
  gRNA target sequence
aggtcagctaaataagctatcgg

SEQ ID NO: 150 - DNA, 23 bp, Artificial Sequence
  gRNA target sequence
ggtcagctaaataagctatcggg

SEQ ID NO: 151 - DNA, 23 bp, Artificial Sequence
  gRNA target sequence
ggcccataccccgaaaatgttgg

SEQ ID NO: 152 - DNA, 23 bp, Artificial Sequence
  gRNA target sequence
tcccgtactaattaatcccctgg

SEQ ID NO: 153 - DNA, 23 bp, Artificial Sequence
  gRNA target sequence
atctactctaccatctttgcagg

SEQ ID NO: 154 - DNA, 23 bp, Artificial Sequence
  gRNA target sequence
cactgattttttacctgagtagg

SEQ ID NO: 155 - DNA, 23 bp, Artificial Sequence
  gRNA target sequence
ctcttcaacaatatactctccgg

SEQ ID NO: 156 - DNA, 23 bp, Artificial Sequence
  gRNA target sequence
atagctatagcaataaaactagg

SEQ ID NO: 157 - DNA, 23 bp, Artificial Sequence
  gRNA target sequence
ctttcacttctgagtcccagagg

SEQ ID NO: 158 - DNA, 23 bp, Artificial Sequence
  gRNA target sequence
tgagtcccagaggttacccaagg

SEQ ID NO: 159 - DNA, 23 bp, Artificial Sequence
  gRNA target sequence
caaggcacccctctgacatccgg

SEQ ID NO: 160 - DNA, 23 bp, Artificial Sequence
  gRNA target sequence
tcaatcttatccatcatagcagg

SEQ ID NO: 161 - DNA, 23 bp, Artificial Sequence
  gRNA target sequence
tccatcatagcaggcagttgagg

SEQ ID NO: 162 - DNA, 23 bp, Artificial Sequence
  gRNA target sequence
atcatagcaggcagttgaggtgg

SEQ ID NO: 163 - DNA, 23 bp, Artificial Sequence
  gRNA target sequence
tactcctcaattacccacatagg

SEQ ID NO: 164 - DNA, 23 bp, Artificial Sequence
  gRNA target sequence
ccatccaccctcctctccctagg

SEQ ID NO: 165 - DNA, 23 bp, Artificial Sequence
  gRNA target sequence
tccaccctcctctccctaggagg

SEQ ID NO: 166 - DNA, 23 bp, Artificial Sequence
  gRNA target sequence
ggaggcctgcccccgctaaccgg

SEQ ID NO: 167 - DNA, 23 bp, Artificial Sequence
  gRNA target sequence
taaccggctttttgcccaaatgg

SEQ ID NO: 168 - DNA, 23 bp, Artificial Sequence
  gRNA target sequence
aaccggctttttgcccaaatggg

SEQ ID NO: 169 - DNA, 23 bp, Artificial Sequence
  gRNA target sequence
taataatcttatagaaatttagg

SEQ ID NO: 170 - DNA, 23 bp, Artificial Sequence
  gRNA target sequence
cttaatttctgtaacagctaagg

SEQ ID NO: 171 - DNA, 23 bp, Artificial Sequence
  gRNA target sequence
ctaagcccttactagaccaatgg

SEQ ID NO: 172 - DNA, 23 bp, Artificial Sequence
  gRNA target sequence
taagcccttactagaccaatggg

SEQ ID NO: 173 - DNA, 23 bp, Artificial Sequence
  gRNA target sequence
agctaagcaccctaatcaactgg

SEQ ID NO: 174 - DNA, 23 bp, Artificial Sequence
  gRNA target sequence
caatctacttctcccgccgccgg

SEQ ID NO: 175 - DNA, 23 bp, Artificial Sequence
  gRNA target sequence
aatctacttctcccgccgccggg

SEQ ID NO: 176 - DNA, 23 bp, Artificial Sequence
  gRNA target sequence
tctcccgccgccgggaaaaaagg

SEQ ID NO: 177 - DNA, 23 bp, Artificial Sequence
  gRNA target sequence
cccgccgccgggaaaaaaggcgg

SEQ ID NO: 178 - DNA, 23 bp, Artificial Sequence
  gRNA target sequence
ccgccgccgggaaaaaaggcggg

SEQ ID NO: 179 - DNA, 23 bp, Artificial Sequence
  gRNA target sequence
aaaaaaggcgggagaagccccgg

SEQ ID NO: 180 - DNA, 23 bp, Artificial Sequence
  gRNA target sequence
aaggcgggagaagccccggcagg

SEQ ID NO: 181 - DNA, 23 bp, Artificial Sequence
  gRNA target sequence
attcaatatgaaaatcacctcgg

SEQ ID NO: 182 - DNA, 23 bp, Artificial Sequence
  gRNA target sequence
tatgaaaatcacctcggagctgg

SEQ ID NO: 183 - DNA, 23 bp, Artificial Sequence
  gRNA target sequence
acctcggagctggtaaaaagagg

SEQ ID NO: 184 - DNA, 23 bp, Artificial Sequence
  gRNA target sequence
tctacaaaccacaaagacattgg

SEQ ID NO: 185 - DNA, 23 bp, Artificial Sequence
  gRNA target sequence
ggaacactatacctattattcgg

SEQ ID NO: 186 - DNA, 23 bp, Artificial Sequence
  gRNA target sequence
ctattattcggcgcatgagctgg

SEQ ID NO: 187 - DNA, 23 bp, Artificial Sequence
  gRNA target sequence
ggcgcatgagctggagtcctagg

SEQ ID NO: 188 - DNA, 23 bp, Artificial Sequence
  gRNA target sequence
cctccttattcgagccgagctgg

SEQ ID NO: 189 - DNA, 23 bp, Artificial Sequence
  gRNA target sequence
ctccttattcgagccgagctggg

SEQ ID NO: 190 - DNA, 23 bp, Artificial Sequence
  gRNA target sequence
ggccagccaggcaaccttctagg

SEQ ID NO: 191 - DNA, 23 bp, Artificial Sequence
  gRNA target sequence
atagtaatacccatcataatcgg

SEQ ID NO: 192 - DNA, 23 bp, Artificial Sequence
  gRNA target sequence
gtaatacccatcataatcggagg

SEQ ID NO: 193 - DNA, 23 bp, Artificial Sequence
  gRNA target sequence
cccatcataatcggaggctttgg

SEQ ID NO: 194 - DNA, 23 bp, Artificial Sequence
  gRNA target sequence
tgactagttcccctaataatcgg

SEQ ID NO: 195 - DNA, 23 bp, Artificial Sequence
  gRNA target sequence
aataatcggtgcccccgatatgg

SEQ ID NO: 196 - DNA, 23 bp, Artificial Sequence
  gRNA target sequence
cctgctcgcatctgctatagtgg

SEQ ID NO: 197 - DNA, 23 bp, Artificial Sequence
  gRNA target sequence
gctcgcatctgctatagtggagg

SEQ ID NO: 198 - DNA, 23 bp, Artificial Sequence
  gRNA target sequence
gcatctgctatagtggaggccgg

SEQ ID NO: 199 - DNA, 23 bp, Artificial Sequence
  gRNA target sequence
gctatagtggaggccggagcagg

SEQ ID NO: 200 - DNA, 23 bp, Artificial Sequence
  gRNA target sequence
gtggaggccggagcaggaacagg

SEQ ID NO: 201 - DNA, 23 bp, Artificial Sequence
  gRNA target sequence
acagtctaccctcccttagcagg

SEQ ID NO: 202 - DNA, 23 bp, Artificial Sequence
  gRNA target sequence
cagtctaccctcccttagcaggg

SEQ ID NO: 203 - DNA, 23 bp, Artificial Sequence
  gRNA target sequence
gcagggaactactcccaccctgg

SEQ ID NO: 204 - DNA, 23 bp, Artificial Sequence
  gRNA target sequence
atcttctccttacacctagcagg

SEQ ID NO: 205 - DNA, 23 bp, Artificial Sequence
  gRNA target sequence
gcaggtgtctcctctatcttagg

SEQ ID NO: 206 - DNA, 23 bp, Artificial Sequence
  gRNA target sequence
caggtgtctcctctatcttaggg

SEQ ID NO: 207 - DNA, 23 bp, Artificial Sequence
  gRNA target sequence
aggtgtctcctctatcttagggg

SEQ ID NO: 208 - DNA, 23 bp, Artificial Sequence
  gRNA target sequence
tctctcccagtcctagctgctgg

SEQ ID NO: 209 - DNA, 23 bp, Artificial Sequence
  gRNA target sequence
accaccttcttcgaccccgccgg

SEQ ID NO: 210 - DNA, 23 bp, Artificial Sequence
  gRNA target sequence
accttcttcgaccccgccggagg

SEQ ID NO: 211 - DNA, 23 bp, Artificial Sequence
  gRNA target sequence
ttcttcgaccccgccggaggagg

SEQ ID NO: 212 - DNA, 23 bp, Artificial Sequence
  gRNA target sequence
caacacctattctgatttttcgg

SEQ ID NO: 213 - DNA, 23 bp, Artificial Sequence
  gRNA target sequence
gtttatattcttatcctaccagg

SEQ ID NO: 214 - DNA, 23 bp, Artificial Sequence
  gRNA target sequence
attcttatcctaccaggcttcgg

SEQ ID NO: 215 - DNA, 23 bp, Artificial Sequence
  gRNA target sequence
catattgtaacttactactccgg

SEQ ID NO: 216 - DNA, 23 bp, Artificial Sequence
  gRNA target sequence
tccggaaaaaaagaaccatttgg

SEQ ID NO: 217 - DNA, 23 bp, Artificial Sequence
  gRNA target sequence
aaagaaccatttggatacatagg

SEQ ID NO: 218 - DNA, 23 bp, Artificial Sequence
  gRNA target sequence
accatttggatacataggtatgg

SEQ ID NO: 219 - DNA, 23 bp, Artificial Sequence
  gRNA target sequence
gtctgagctatgatatcaattgg

SEQ ID NO: 220 - DNA, 23 bp, Artificial Sequence
  gRNA target sequence
atgatatcaattggcttcctagg

SEQ ID NO: 221 - DNA, 23 bp, Artificial Sequence
  gRNA target sequence
tgatatcaattggcttcctaggg

SEQ ID NO: 222 - DNA, 23 bp, Artificial Sequence
  gRNA target sequence
gcacaccatatatttacagtagg

SEQ ID NO: 223 - DNA, 23 bp, Artificial Sequence
  gRNA target sequence
ataatcatcgctatccccaccgg

SEQ ID NO: 224 - DNA, 23 bp, Artificial Sequence
  gRNA target sequence
agctgactcgccacactccacgg

SEQ ID NO: 225 - DNA, 23 bp, Artificial Sequence
  gRNA target sequence
gctgcagtgctctgagccctagg

SEQ ID NO: 226 - DNA, 23 bp, Artificial Sequence
  gRNA target sequence
ttcatctttcttttcaccgtagg

SEQ ID NO: 227 - DNA, 23 bp, Artificial Sequence
  gRNA target sequence
atctttcttttcaccgtaggtgg

SEQ ID NO: 228 - DNA, 23 bp, Artificial Sequence
  gRNA target sequence
ttcaccgtaggtggcctgactgg

SEQ ID NO: 229 - DNA, 23 bp, Artificial Sequence
  gRNA target sequence
ttccactatgtcctatcaatagg

SEQ ID NO: 230 - DNA, 23 bp, Artificial Sequence
  gRNA target sequence
ggagctgtatttgccatcatagg

SEQ ID NO: 231 - DNA, 23 bp, Artificial Sequence
  gRNA target sequence
gctgtatttgccatcataggagg

SEQ ID NO: 232 - DNA, 23 bp, Artificial Sequence
  gRNA target sequence
cactgatttcccctattctcagg

SEQ ID NO: 233 - DNA, 23 bp, Artificial Sequence
  gRNA target sequence
catttcactatcatattcatcgg

SEQ ID NO: 234 - DNA, 23 bp, Artificial Sequence
  gRNA target sequence
ttcttcccacaacactttctcgg

SEQ ID NO: 235 - DNA, 23 bp, Artificial Sequence
  gRNA target sequence
caacactttctcggcctatccgg

SEQ ID NO: 236 - DNA, 23 bp, Artificial Sequence
  gRNA target sequence
cggaatgccccgacgttactcgg

SEQ ID NO: 237 - DNA, 23 bp, Artificial Sequence
  gRNA target sequence
tgaaacatcctatcatctgtagg

SEQ ID NO: 238 - DNA, 23 bp, Artificial Sequence
  gRNA target sequence
agaagaaccctccataaacctgg

SEQ ID NO: 239 - DNA, 23 bp, Artificial Sequence
  gRNA target sequence
ataaacctggagtgactatatgg

SEQ ID NO: 240 - DNA, 23 bp, Artificial Sequence
  gRNA target sequence
acataaaatctagacaaaaaagg

SEQ ID NO: 241 - DNA, 23 bp, Artificial Sequence
  gRNA target sequence
aaaatctagacaaaaaaggaagg

SEQ ID NO: 242 - DNA, 23 bp, Artificial Sequence
  gRNA target sequence
ggaatcgaaccccccaaagctgg

SEQ ID NO: 243 - DNA, 23 bp, Artificial Sequence
  gRNA target sequence
ctggtttcaagccaaccccatgg

SEQ ID NO: 244 - DNA, 23 bp, Artificial Sequence
  gRNA target sequence
cctccatgactttttcaaaaagg

SEQ ID NO: 245 - DNA, 23 bp, Artificial Sequence
  gRNA target sequence
ctttgtcaaagttaaattatagg

SEQ ID NO: 246 - DNA, 23 bp, Artificial Sequence
  gRNA target sequence
ctaaatcctatatatcttaatgg

SEQ ID NO: 247 - DNA, 23 bp, Artificial Sequence
  gRNA target sequence
atggcacatgcagcgcaagtagg

SEQ ID NO: 248 - DNA, 23 bp, Artificial Sequence
  gRNA target sequence
tactaacatctcagacgctcagg

SEQ ID NO: 249 - DNA, 23 bp, Artificial Sequence
  gRNA target sequence
catcctttacataacagacgagg

SEQ ID NO: 250 - DNA, 23 bp, Artificial Sequence
  gRNA target sequence
tcccttaccatcaaatcaattgg

SEQ ID NO: 251 - DNA, 23 bp, Artificial Sequence
  gRNA target sequence
tcaaatcaattggccaccaatgg

SEQ ID NO: 252 - DNA, 23 bp, Artificial Sequence
  gRNA target sequence
acctacgagtacaccgactacgg

SEQ ID NO: 253 - DNA, 23 bp, Artificial Sequence
  gRNA target sequence
tacgagtacaccgactacggcgg

SEQ ID NO: 254 - DNA, 23 bp, Artificial Sequence
  gRNA target sequence
cccccattattcctagaaccagg

SEQ ID NO: 255 - DNA, 23 bp, Artificial Sequence
  gRNA target sequence
tcatgagctgtccccacattagg

SEQ ID NO: 256 - DNA, 23 bp, Artificial Sequence
  gRNA target sequence
ttaaaaacagatgcaattcccgg

SEQ ID NO: 257 - DNA, 23 bp, Artificial Sequence
  gRNA target sequence
cactttcaccgctacacgaccgg

SEQ ID NO: 258 - DNA, 23 bp, Artificial Sequence
  gRNA target sequence
actttcaccgctacacgaccggg

SEQ ID NO: 259 - DNA, 23 bp, Artificial Sequence
  gRNA target sequence
ctttcaccgctacacgaccgggg

SEQ ID NO: 260 - DNA, 23 bp, Artificial Sequence
  gRNA target sequence
tttcaccgctacacgaccggggg

SEQ ID NO: 261 - DNA, 23 bp, Artificial Sequence
  gRNA target sequence
acacgaccgggggtatactacgg

SEQ ID NO: 262 - DNA, 23 bp, Artificial Sequence
  gRNA target sequence
ggtcaatgctctgaaatctgtgg

SEQ ID NO: 263 - DNA, 23 bp, Artificial Sequence
  gRNA target sequence
cccctaaaaatctttgaaatagg

SEQ ID NO: 264 - DNA, 23 bp, Artificial Sequence
  gRNA target sequence
ccctaaaaatctttgaaataggg

SEQ ID NO: 265 - DNA, 23 bp, Artificial Sequence
  gRNA target sequence
cccaactaaatactaccgtatgg

SEQ ID NO: 266 - DNA, 23 bp, Artificial Sequence
  gRNA target sequence
ttcattgcccccacaatcctagg

SEQ ID NO: 267 - DNA, 23 bp, Artificial Sequence
  gRNA target sequence
ataaccatacacaacactaaagg

SEQ ID NO: 268 - DNA, 23 bp, Artificial Sequence
  gRNA target sequence
attgccacaactaacctcctcgg

SEQ ID NO: 269 - DNA, 23 bp, Artificial Sequence
  gRNA target sequence
actatctataaacctagccatgg

SEQ ID NO: 270 - DNA, 23 bp, Artificial Sequence
  gRNA target sequence
catggccatccccttatgagcgg

SEQ ID NO: 271 - DNA, 23 bp, Artificial Sequence
  gRNA target sequence
atggccatccccttatgagcggg

SEQ ID NO: 272 - DNA, 23 bp, Artificial Sequence
  gRNA target sequence
tgagcgggcacagtgattatagg

SEQ ID NO: 273 - DNA, 23 bp, Artificial Sequence
  gRNA target sequence
ctagcccacttcttaccacaagg

SEQ ID NO: 274 - DNA, 23 bp, Artificial Sequence
  gRNA target sequence
actcattcaaccaatagccctgg

SEQ ID NO: 275 - DNA, 23 bp, Artificial Sequence
  gRNA target sequence
ctaaccgctaacattactgcagg

SEQ ID NO: 276 - DNA, 23 bp, Artificial Sequence
  gRNA target sequence
cacctactcatgcacctaattgg

SEQ ID NO: 277 - DNA, 23 bp, Artificial Sequence
  gRNA target sequence
cccagcccatgacccctaacagg

SEQ ID NO: 278 - DNA, 23 bp, Artificial Sequence
  gRNA target sequence
ccagcccatgacccctaacaggg

SEQ ID NO: 279 - DNA, 23 bp, Artificial Sequence
  gRNA target sequence
cagcccatgacccctaacagggg

SEQ ID NO: 280 - DNA, 23 bp, Artificial Sequence
  gRNA target sequence
tcagccctcctaatgacctccgg

SEQ ID NO: 281 - DNA, 23 bp, Artificial Sequence
  gRNA target sequence
tccataacgctcctcatactagg

SEQ ID NO: 282 - DNA, 23 bp, Artificial Sequence
  gRNA target sequence
cactaaccatataccaatgatgg

SEQ ID NO: 283 - DNA, 23 bp, Artificial Sequence
  gRNA target sequence
acacgagaaagcacataccaagg

SEQ ID NO: 284 - DNA, 23 bp, Artificial Sequence
  gRNA target sequence
cacacaccacctgtccaaaaagg

SEQ ID NO: 285 - DNA, 23 bp, Artificial Sequence
  gRNA target sequence
gtccaaaaaggccttcgatacgg

SEQ ID NO: 286 - DNA, 23 bp, Artificial Sequence
  gRNA target sequence
tccaaaaaggccttcgatacggg

SEQ ID NO: 287 - DNA, 23 bp, Artificial Sequence
  gRNA target sequence
tcagaagtttttttcttcgcagg

SEQ ID NO: 288 - DNA, 23 bp, Artificial Sequence
  gRNA target sequence
ctagcccctaccccccaattagg

SEQ ID NO: 289 - DNA, 23 bp, Artificial Sequence
  gRNA target sequence
gcccctaccccccaattaggagg

SEQ ID NO: 290 - DNA, 23 bp, Artificial Sequence
  gRNA target sequence
cccctaccccccaattaggaggg

SEQ ID NO: 291 - DNA, 23 bp, Artificial Sequence
  gRNA target sequence
ccccccaattaggagggcactgg

SEQ ID NO: 292 - DNA, 23 bp, Artificial Sequence
  gRNA target sequence
ggagggcactggcccccaacagg

SEQ ID NO: 293 - DNA, 23 bp, Artificial Sequence
  gRNA target sequence
acatccgtattactcgcatcagg

SEQ ID NO: 294 - DNA, 23 bp, Artificial Sequence
  gRNA target sequence
actgcttattacaattttactgg

SEQ ID NO: 295 - DNA, 23 bp, Artificial Sequence
  gRNA target sequence
ctgcttattacaattttactggg

SEQ ID NO: 296 - DNA, 23 bp, Artificial Sequence
  gRNA target sequence
tctcccttcaccatttccgacgg

SEQ ID NO: 297 - DNA, 23 bp, Artificial Sequence
  gRNA target sequence
accatttccgacggcatctacgg

SEQ ID NO: 298 - DNA, 23 bp, Artificial Sequence
  gRNA target sequence
tcaacattttttgtagccacagg

SEQ ID NO: 299 - DNA, 23 bp, Artificial Sequence
  gRNA target sequence
tttgtagccacaggcttccacgg

SEQ ID NO: 300 - DNA, 23 bp, Artificial Sequence
  gRNA target sequence
cacggacttcacgtcattattgg

SEQ ID NO: 301 - DNA, 23 bp, Artificial Sequence
  gRNA target sequence
tttacatccaaacatcactttgg

SEQ ID NO: 302 - DNA, 23 bp, Artificial Sequence
  gRNA target sequence
tcgaagccgccgcctgatactgg

SEQ ID NO: 303 - DNA, 23 bp, Artificial Sequence
  gRNA target sequence
atactggcattttgtagatgtgg

SEQ ID NO: 304 - DNA, 23 bp, Artificial Sequence
  gRNA target sequence
tatgtctccatctattgatgagg

SEQ ID NO: 305 - DNA, 23 bp, Artificial Sequence
  gRNA target sequence
atgtctccatctattgatgaggg

SEQ ID NO: 306 - DNA, 23 bp, Artificial Sequence
  gRNA target sequence
ttttgactaccacaactcaacgg

SEQ ID NO: 307 - DNA, 23 bp, Artificial Sequence
  gRNA target sequence
aaatccaccccttacgagtgcgg

SEQ ID NO: 308 - DNA, 23 bp, Artificial Sequence
  gRNA target sequence
catcatcctagccctaagtctgg

SEQ ID NO: 309 - DNA, 23 bp, Artificial Sequence
  gRNA target sequence
gcctatgagtgactacaaaaagg

SEQ ID NO: 310 - DNA, 23 bp, Artificial Sequence
  gRNA target sequence
aggattagactgaaccgaattgg

SEQ ID NO: 311 - DNA, 23 bp, Artificial Sequence
  gRNA target sequence
gcatttaccatctcacttctagg

SEQ ID NO: 312 - DNA, 23 bp, Artificial Sequence
  gRNA target sequence
tcctccctactatgcctagaagg

SEQ ID NO: 313 - DNA, 23 bp, Artificial Sequence
  gRNA target sequence
ctttgccgcctgcgaagcagcgg

SEQ ID NO: 314 - DNA, 23 bp, Artificial Sequence
  gRNA target sequence
tgccgcctgcgaagcagcggtgg

SEQ ID NO: 315 - DNA, 23 bp, Artificial Sequence
  gRNA target sequence
gccgcctgcgaagcagcggtggg

SEQ ID NO: 316 - DNA, 23 bp, Artificial Sequence
  gRNA target sequence
gtctcaatctccaacacatatgg

SEQ ID NO: 317 - DNA, 23 bp, Artificial Sequence
  gRNA target sequence
actcctacccctcacaatcatgg

SEQ ID NO: 318 - DNA, 23 bp, Artificial Sequence
  gRNA target sequence
aaccacacttatccccaccttgg

SEQ ID NO: 319 - DNA, 23 bp, Artificial Sequence
  gRNA target sequence
ttggctatcatcacccgatgagg

SEQ ID NO: 320 - DNA, 23 bp, Artificial Sequence
  gRNA target sequence
cagccagaacgcctgaacgcagg

SEQ ID NO: 321 - DNA, 23 bp, Artificial Sequence
  gRNA target sequence
ttcctattctacaccctagtagg

SEQ ID NO: 322 - DNA, 23 bp, Artificial Sequence
  gRNA target sequence
atttacactcacaacaccctagg

SEQ ID NO: 323 - DNA, 23 bp, Artificial Sequence
  gRNA target sequence
atagtaaagatacctctttacgg

SEQ ID NO: 324 - DNA, 23 bp, Artificial Sequence
  gRNA target sequence
catgtcgaagcccccatcgctgg

SEQ ID NO: 325 - DNA, 23 bp, Artificial Sequence
  gRNA target sequence
atgtcgaagcccccatcgctggg

SEQ ID NO: 326 - DNA, 23 bp, Artificial Sequence
  gRNA target sequence
gccgcagtactcttaaaactagg

SEQ ID NO: 327 - DNA, 23 bp, Artificial Sequence
  gRNA target sequence
gcagtactcttaaaactaggcgg

SEQ ID NO: 328 - DNA, 23 bp, Artificial Sequence
  gRNA target sequence
ctcttaaaactaggcggctatgg

SEQ ID NO: 329 - DNA, 23 bp, Artificial Sequence
  gRNA target sequence
ttccttgtactatccctatgagg

SEQ ID NO: 330 - DNA, 23 bp, Artificial Sequence
  gRNA target sequence
caaaccccctgaagcttcaccgg

SEQ ID NO: 331 - DNA, 23 bp, Artificial Sequence
  gRNA target sequence
gtcattctcataatcgcccacgg

SEQ ID NO: 332 - DNA, 23 bp, Artificial Sequence
  gRNA target sequence
tcattctcataatcgcccacggg

SEQ ID NO: 333 - DNA, 23 bp, Artificial Sequence
  gRNA target sequence
cgcatcataatcctctctcaagg

SEQ ID NO: 334 - DNA, 23 bp, Artificial Sequence
  gRNA target sequence
accccccactattaacctactgg

SEQ ID NO: 335 - DNA, 23 bp, Artificial Sequence
  gRNA target sequence
ccccccactattaacctactggg

SEQ ID NO: 336 - DNA, 23 bp, Artificial Sequence
  gRNA target sequence
aatatcactctcctacttacagg

SEQ ID NO: 337 - DNA, 23 bp, Artificial Sequence
  gRNA target sequence
acatatttaccacaacacaatgg

SEQ ID NO: 338 - DNA, 23 bp, Artificial Sequence
  gRNA target sequence
catatttaccacaacacaatggg

SEQ ID NO: 339 - DNA, 23 bp, Artificial Sequence
  gRNA target sequence
atatttaccacaacacaatgggg

SEQ ID NO: 340 - DNA, 23 bp, Artificial Sequence
  gRNA target sequence
ctcaaccccgacatcattaccgg

SEQ ID NO: 341 - DNA, 23 bp, Artificial Sequence
  gRNA target sequence
tcaaccccgacatcattaccggg

SEQ ID NO: 342 - DNA, 23 bp, Artificial Sequence
  gRNA target sequence
gattgtgaatctgacaacagagg

SEQ ID NO: 343 - DNA, 23 bp, Artificial Sequence
  gRNA target sequence
tgcccccatgtctaacaacatgg

SEQ ID NO: 344 - DNA, 23 bp, Artificial Sequence
  gRNA target sequence
atggctttctcaacttttaaagg

SEQ ID NO: 345 - DNA, 23 bp, Artificial Sequence
  gRNA target sequence
aaaggataacagctatccattgg

SEQ ID NO: 346 - DNA, 23 bp, Artificial Sequence
  gRNA target sequence
aacagctatccattggtcttagg

SEQ ID NO: 347 - DNA, 23 bp, Artificial Sequence
  gRNA target sequence
gtcttaggccccaaaaattttgg

SEQ ID NO: 348 - DNA, 23 bp, Artificial Sequence
  gRNA target sequence
ctgtagcattgttcgttacatgg

SEQ ID NO: 349 - DNA, 23 bp, Artificial Sequence
  gRNA target sequence
aacctattccaactgttcatcgg

SEQ ID NO: 350 - DNA, 23 bp, Artificial Sequence
  gRNA target sequence
ccaactgttcatcggctgagagg

SEQ ID NO: 351 - DNA, 23 bp, Artificial Sequence
  gRNA target sequence
caactgttcatcggctgagaggg

SEQ ID NO: 352 - DNA, 23 bp, Artificial Sequence
  gRNA target sequence
ttcatcggctgagagggcgtagg

SEQ ID NO: 353 - DNA, 23 bp, Artificial Sequence
  gRNA target sequence
gcaatcctatacaaccgtatcgg

SEQ ID NO: 354 - DNA, 23 bp, Artificial Sequence
  gRNA target sequence
tacaaccgtatcggcgatatcgg

SEQ ID NO: 355 - DNA, 23 bp, Artificial Sequence
  gRNA target sequence
ccaagcctcaccccactactagg

SEQ ID NO: 356 - DNA, 23 bp, Artificial Sequence
  gRNA target sequence
ggcctcctcctagcagcagcagg

SEQ ID NO: 357 - DNA, 23 bp, Artificial Sequence
  gRNA target sequence
gcaggcaaatcagcccaattagg

SEQ ID NO: 358 - DNA, 23 bp, Artificial Sequence
  gRNA target sequence
tgactcccctcagccatagaagg

SEQ ID NO: 359 - DNA, 23 bp, Artificial Sequence
  gRNA target sequence
tcaagcactatagttgtagcagg

SEQ ID NO: 360 - DNA, 23 bp, Artificial Sequence
  gRNA target sequence
caaactctaacactatgcttagg

SEQ ID NO: 361 - DNA, 23 bp, Artificial Sequence
  gRNA target sequence
ttctccacttcaagtcaactagg

SEQ ID NO: 362 - DNA, 23 bp, Artificial Sequence
  gRNA target sequence
ggactcataatagttacaatcgg

SEQ ID NO: 363 - DNA, 23 bp, Artificial Sequence
  gRNA target sequence
gccatactatttatgtgctccgg

SEQ ID NO: 364 - DNA, 23 bp, Artificial Sequence
  gRNA target sequence
ccatactatttatgtgctccggg

SEQ ID NO: 365 - DNA, 23 bp, Artificial Sequence
  gRNA target sequence
gaacaagatattcgaaaaatagg

SEQ ID NO: 366 - DNA, 23 bp, Artificial Sequence
  gRNA target sequence
caagatattcgaaaaataggagg

SEQ ID NO: 367 - DNA, 23 bp, Artificial Sequence
  gRNA target sequence
acttcaacctccctcaccattgg

SEQ ID NO: 368 - DNA, 23 bp, Artificial Sequence
  gRNA target sequence
attggcagcctagcattagcagg

SEQ ID NO: 369 - DNA, 23 bp, Artificial Sequence
  gRNA target sequence
gcaggaatacctttcctcacagg

SEQ ID NO: 370 - DNA, 23 bp, Artificial Sequence
  gRNA target sequence
ataattcttctcaccctaacagg

SEQ ID NO: 371 - DNA, 23 bp, Artificial Sequence
  gRNA target sequence
actaaaccccattaaacgcctgg

SEQ ID NO: 372 - DNA, 23 bp, Artificial Sequence
  gRNA target sequence
cccattaaacgcctggcagccgg

SEQ ID NO: 373 - DNA, 23 bp, Artificial Sequence
  gRNA target sequence
gcagccggaagcctattcgcagg

SEQ ID NO: 374 - DNA, 23 bp, Artificial Sequence
  gRNA target sequence
gccctcgctgtcactttcctagg

SEQ ID NO: 375 - DNA, 23 bp, Artificial Sequence
  gRNA target sequence
ttttatttctccaacatactcgg

SEQ ID NO: 376 - DNA, 23 bp, Artificial Sequence
  gRNA target sequence
caccgcacaatcccctatctagg

SEQ ID NO: 377 - DNA, 23 bp, Artificial Sequence
  gRNA target sequence
atcatcacctcaacccaaaaagg

SEQ ID NO: 378 - DNA, 23 bp, Artificial Sequence
  gRNA target sequence
tacaaagcccccgcaccaatagg

SEQ ID NO: 379 - DNA, 23 bp, Artificial Sequence
  gRNA target sequence
acccctgacccccatgcctcagg

SEQ ID NO: 380 - DNA, 23 bp, Artificial Sequence
  gRNA target sequence
aatactaaacccccataaatagg

SEQ ID NO: 381 - DNA, 23 bp, Artificial Sequence
  gRNA target sequence
aaacccccataaataggagaagg

SEQ ID NO: 382 - DNA, 23 bp, Artificial Sequence
  gRNA target sequence
catacatcattattctcgcacgg

SEQ ID NO: 383 - DNA, 23 bp, Artificial Sequence
  gRNA target sequence
atctccgcatgatgaaacttcgg

SEQ ID NO: 384 - DNA, 23 bp, Artificial Sequence
  gRNA target sequence
tgaaacttcggctcactccttgg

SEQ ID NO: 385 - DNA, 23 bp, Artificial Sequence
  gRNA target sequence
ctgatcctccaaatcaccacagg

SEQ ID NO: 386 - DNA, 23 bp, Artificial Sequence
  gRNA target sequence
atcactcgagacgtaaattatgg

SEQ ID NO: 387 - DNA, 23 bp, Artificial Sequence
  gRNA target sequence
atccgctaccttcacgccaatgg

SEQ ID NO: 388 - DNA, 23 bp, Artificial Sequence
  gRNA target sequence
atctgcctcttcctacacatcgg

SEQ ID NO: 389 - DNA, 23 bp, Artificial Sequence
  gRNA target sequence
tctgcctcttcctacacatcggg

SEQ ID NO: 390 - DNA, 23 bp, Artificial Sequence
  gRNA target sequence
ctcttcctacacatcgggcgagg

SEQ ID NO: 391 - DNA, 23 bp, Artificial Sequence
  gRNA target sequence
atcgggcgaggcctatattacgg

SEQ ID NO: 392 - DNA, 23 bp, Artificial Sequence
  gRNA target sequence
tactcagaaacctgaaacatcgg

SEQ ID NO: 393 - DNA, 23 bp, Artificial Sequence
  gRNA target sequence
actatagcaacagccttcatagg

SEQ ID NO: 394 - DNA, 23 bp, Artificial Sequence
  gRNA target sequence
ataggctatgtcctcccgtgagg

SEQ ID NO: 395 - DNA, 23 bp, Artificial Sequence
  gRNA target sequence
tgaggccaaatatcattctgagg

SEQ ID NO: 396 - DNA, 23 bp, Artificial Sequence
  gRNA target sequence
gaggccaaatatcattctgaggg

SEQ ID NO: 397 - DNA, 23 bp, Artificial Sequence
  gRNA target sequence
aggccaaatatcattctgagggg

SEQ ID NO: 398 - DNA, 23 bp, Artificial Sequence
  gRNA target sequence
ctatccgccatcccatacattgg

SEQ ID NO: 399 - DNA, 23 bp, Artificial Sequence
  gRNA target sequence
tatccgccatcccatacattggg

SEQ ID NO: 400 - DNA, 23 bp, Artificial Sequence
  gRNA target sequence
gacctagttcaatgaatctgagg

SEQ ID NO: 401 - DNA, 23 bp, Artificial Sequence
  gRNA target sequence
ctagttcaatgaatctgaggagg

SEQ ID NO: 402 - DNA, 23 bp, Artificial Sequence
  gRNA target sequence
cctcctattcttgcacgaaacgg

SEQ ID NO: 403 - DNA, 23 bp, Artificial Sequence
  gRNA target sequence
ctcctattcttgcacgaaacggg

SEQ ID NO: 404 - DNA, 23 bp, Artificial Sequence
  gRNA target sequence
acgggatcaaacaaccccctagg

SEQ ID NO: 405 - DNA, 23 bp, Artificial Sequence
  gRNA target sequence
tacacaatcaaagacgccctcgg

SEQ ID NO: 406 - DNA, 23 bp, Artificial Sequence
  gRNA target sequence
ctattctcaccagacctcctagg

SEQ ID NO: 407 - DNA, 23 bp, Artificial Sequence
  gRNA target sequence
cgatccgtccctaacaaactagg

SEQ ID NO: 408 - DNA, 23 bp, Artificial Sequence
  gRNA target sequence
tccgtccctaacaaactaggagg

SEQ ID NO: 409 - DNA, 23 bp, Artificial Sequence
  gRNA target sequence
ctcctcattctaacctgaatcgg

SEQ ID NO: 410 - DNA, 23 bp, Artificial Sequence
  gRNA target sequence
ctcattctaacctgaatcggagg

SEQ ID NO: 411 - DNA, 23 bp, Artificial Sequence
  gRNA target sequence
agctacccttttaccatcattgg

SEQ ID NO: 412 - DNA, 23 bp, Artificial Sequence
  gRNA target sequence
ttgaaaacaaaatactcaaatgg

SEQ ID NO: 413 - DNA, 23 bp, Artificial Sequence
  gRNA target sequence
tgaaaacaaaatactcaaatggg

SEQ ID NO: 414 - DNA, 23 bp, Artificial Sequence
  gRNA target sequence
aatacaccagtcttgtaaaccgg

SEQ ID NO: 415 - DNA, 23 bp, Artificial Sequence
  gRNA target sequence
gagatgaaaacctttttccaagg

SEQ ID NO: 416 - DNA, 23 bp, Artificial Sequence
  gRNA target sequence
aactattctctgttctttcatgg

SEQ ID NO: 417 - DNA, 23 bp, Artificial Sequence
  gRNA target sequence
actattctctgttctttcatggg

SEQ ID NO: 418 - DNA, 23 bp, Artificial Sequence
  gRNA target sequence
ctattctctgttctttcatgggg

SEQ ID NO: 419 - DNA, 23 bp, Artificial Sequence
  gRNA target sequence
ctttcatggggaagcagatttgg

SEQ ID NO: 420 - DNA, 23 bp, Artificial Sequence
  gRNA target sequence
tttcatggggaagcagatttggg

SEQ ID NO: 421 - DNA, 23 bp, Artificial Sequence
  gRNA target sequence
cagccaccatgaatattgtacgg

SEQ ID NO: 422 - DNA, 23 bp, Artificial Sequence
  gRNA target sequence
aaagccacccctcacccactagg

SEQ ID NO: 423 - DNA, 23 bp, Artificial Sequence
  gRNA target sequence
caaatcccttctcgtccccatgg

SEQ ID NO: 424 - DNA, 23 bp, Artificial Sequence
  gRNA target sequence
atggatgacccccctcagatagg

SEQ ID NO: 425 - DNA, 23 bp, Artificial Sequence
  gRNA target sequence
tggatgacccccctcagataggg

SEQ ID NO: 426 - DNA, 23 bp, Artificial Sequence
  gRNA target sequence
ggatgacccccctcagatagggg

SEQ ID NO: 427 - DNA, 23 bp, Artificial Sequence
  gRNA target sequence
gagtgctactctcctcgctccgg

SEQ ID NO: 428 - DNA, 23 bp, Artificial Sequence
  gRNA target sequence
agtgctactctcctcgctccggg

SEQ ID NO: 429 - DNA, 23 bp, Artificial Sequence
  gRNA target sequence
cgctccgggcccataacacttgg

SEQ ID NO: 430 - DNA, 23 bp, Artificial Sequence
  gRNA target sequence
gctccgggcccataacacttggg

SEQ ID NO: 431 - DNA, 23 bp, Artificial Sequence
  gRNA target sequence
ctccgggcccataacacttgggg

SEQ ID NO: 432 - DNA, 23 bp, Artificial Sequence
  gRNA target sequence
tccgggcccataacacttggggg

SEQ ID NO: 433 - DNA, 23 bp, Artificial Sequence
  gRNA target sequence
agtgaactgtatccgacatctgg

SEQ ID NO: 434 - DNA, 23 bp, Artificial Sequence
  gRNA target sequence
cgacatctggttcctacttcagg

SEQ ID NO: 435 - DNA, 23 bp, Artificial Sequence
  gRNA target sequence
gacatctggttcctacttcaggg

SEQ ID NO: 436 - DNA, 20 bp, Artificial Sequence
  gRNA target sequence
atcaccctattaaccactca

SEQ ID NO: 437 - DNA, 20 bp, Artificial Sequence
  gRNA target sequence
tcaccctattaaccactcac

SEQ ID NO: 438 - DNA, 20 bp, Artificial Sequence
  gRNA target sequence
acgggagctctccatgcatt

SEQ ID NO: 439 - DNA, 20 bp, Artificial Sequence
  gRNA target sequence
atgcatttggtattttcgtc

SEQ ID NO: 440 - DNA, 20 bp, Artificial Sequence
  gRNA target sequence
tgcatttggtattttcgtct

SEQ ID NO: 441 - DNA, 20 bp, Artificial Sequence
  gRNA target sequence
gcatttggtattttcgtctg

SEQ ID NO: 442 - DNA, 20 bp, Artificial Sequence
  gRNA target sequence
catttggtattttcgtctgg

SEQ ID NO: 443 - DNA, 20 bp, Artificial Sequence
  gRNA target sequence
atttggtattttcgtctggg

SEQ ID NO: 444 - DNA, 20 bp, Artificial Sequence
  gRNA target sequence
gcgatagcattgcgagacgc

SEQ ID NO: 445 - DNA, 20 bp, Artificial Sequence
  gRNA target sequence
gcattgcgagacgctggagc

SEQ ID NO: 446 - DNA, 20 bp, Artificial Sequence
  gRNA target sequence
gcacctacgttcaatattac

SEQ ID NO: 447 - DNA, 20 bp, Artificial Sequence
  gRNA target sequence
gttaattaattaatgcttgt

SEQ ID NO: 448 - DNA, 20 bp, Artificial Sequence
  gRNA target sequence
aaccccccctcccccgcttc

SEQ ID NO: 449 - DNA, 20 bp, Artificial Sequence
  gRNA target sequence
agatttcaaattttatcttt

SEQ ID NO: 450 - DNA, 20 bp, Artificial Sequence
  gRNA target sequence
tttcaaattttatcttttgg

SEQ ID NO: 451 - DNA, 20 bp, Artificial Sequence
  gRNA target sequence
atacactgaaaatgtttaga

SEQ ID NO: 452 - DNA, 20 bp, Artificial Sequence
  gRNA target sequence
tacactgaaaatgtttagac

SEQ ID NO: 453 - DNA, 20 bp, Artificial Sequence
  gRNA target sequence
acatcaccccataaacaaat

SEQ ID NO: 454 - DNA, 20 bp, Artificial Sequence
  gRNA target sequence
accccataaacaaataggtt

SEQ ID NO: 455 - DNA, 20 bp, Artificial Sequence
  gRNA target sequence
tctaaatcaccacgatcaaa

SEQ ID NO: 456 - DNA, 20 bp, Artificial Sequence
  gRNA target sequence
ttagcctagccacaccccca

SEQ ID NO: 457 - DNA, 20 bp, Artificial Sequence
  gRNA target sequence
tagcctagccacacccccac

SEQ ID NO: 458 - DNA, 20 bp, Artificial Sequence
  gRNA target sequence
aactaagctatactaacccc

SEQ ID NO: 459 - DNA, 20 bp, Artificial Sequence
  gRNA target sequence
actaagctatactaacccca

SEQ ID NO: 460 - DNA, 20 bp, Artificial Sequence
  gRNA target sequence
agctatactaaccccagggt

SEQ ID NO: 461 - DNA, 20 bp, Artificial Sequence
  gRNA target sequence
caatttcgtgccagccaccg

SEQ ID NO: 462 - DNA, 20 bp, Artificial Sequence
  gRNA target sequence
taacccaagtcaatagaagc

SEQ ID NO: 463 - DNA, 20 bp, Artificial Sequence
  gRNA target sequence
cacaaaatagactacgaaag

SEQ ID NO: 464 - DNA, 20 bp, Artificial Sequence
  gRNA target sequence
acaatagctaagacccaaac

SEQ ID NO: 465 - DNA, 20 bp, Artificial Sequence
  gRNA target sequence
caatagctaagacccaaact

SEQ ID NO: 466 - DNA, 20 bp, Artificial Sequence
  gRNA target sequence
agccacagcttaaaactcaa

SEQ ID NO: 467 - DNA, 20 bp, Artificial Sequence
  gRNA target sequence
agcttaaaactcaaaggacc

SEQ ID NO: 468 - DNA, 20 bp, Artificial Sequence
  gRNA target sequence
ttaaaactcaaaggacctgg

SEQ ID NO: 469 - DNA, 20 bp, Artificial Sequence
  gRNA target sequence
ggtgcttcatatccctctag

SEQ ID NO: 470 - DNA, 20 bp, Artificial Sequence
  gRNA target sequence
tcttcagcaaaccctgatga

SEQ ID NO: 471 - DNA, 20 bp, Artificial Sequence
  gRNA target sequence
agtacccacgtaaagacgtt

SEQ ID NO: 472 - DNA, 20 bp, Artificial Sequence
  gRNA target sequence
cacgtaaagacgttaggtca

SEQ ID NO: 473 - DNA, 20 bp, Artificial Sequence
  gRNA target sequence
aggtcaaggtgtagcccatg

SEQ ID NO: 474 - DNA, 20 bp, Artificial Sequence
  gRNA target sequence
tcaaggtgtagcccatgagg

SEQ ID NO: 475 - DNA, 20 bp, Artificial Sequence
  gRNA target sequence
gcccatgaggtggcaagaaa

SEQ ID NO: 476 - DNA, 20 bp, Artificial Sequence
  gRNA target sequence
cccatgaggtggcaagaaat

SEQ ID NO: 477 - DNA, 20 bp, Artificial Sequence
  gRNA target sequence
gatagcccttatgaaactta

SEQ ID NO: 478 - DNA, 20 bp, Artificial Sequence
  gRNA target sequence
atagcccttatgaaacttaa

SEQ ID NO: 479 - DNA, 20 bp, Artificial Sequence
  gRNA target sequence
ttatgaaacttaagggtcga

SEQ ID NO: 480 - DNA, 20 bp, Artificial Sequence
  gRNA target sequence
tgaaacttaagggtcgaagg

SEQ ID NO: 481 - DNA, 20 bp, Artificial Sequence
  gRNA target sequence
agtagagtgcttagttgaac

SEQ ID NO: 482 - DNA, 20 bp, Artificial Sequence
  gRNA target sequence
gtagagtgcttagttgaaca

SEQ ID NO: 483 - DNA, 20 bp, Artificial Sequence
  gRNA target sequence
cctcctcaagtatacttcaa

SEQ ID NO: 484 - DNA, 20 bp, Artificial Sequence
  gRNA target sequence
acccctacgcatttatatag

SEQ ID NO: 485 - DNA, 20 bp, Artificial Sequence
  gRNA target sequence
agaggagacaagtcgtaaca

SEQ ID NO: 486 - DNA, 20 bp, Artificial Sequence
  gRNA target sequence
tcgtaacatggtaagtgtac

SEQ ID NO: 487 - DNA, 20 bp, Artificial Sequence
  gRNA target sequence
agtgtactggaaagtgcact

SEQ ID NO: 488 - DNA, 20 bp, Artificial Sequence
  gRNA target sequence
aaagcacccaacttacactt

SEQ ID NO: 489 - DNA, 20 bp, Artificial Sequence
  gRNA target sequence
catttacccaaataaagtat

SEQ ID NO: 490 - DNA, 20 bp, Artificial Sequence
  gRNA target sequence
aggcgatagaaattgaaacc

SEQ ID NO: 491 - DNA, 20 bp, Artificial Sequence
  gRNA target sequence
gcaatagatatagtaccgca

SEQ ID NO: 492 - DNA, 20 bp, Artificial Sequence
  gRNA target sequence
caatagatatagtaccgcaa

SEQ ID NO: 493 - DNA, 20 bp, Artificial Sequence
  gRNA target sequence
taaccaagcataatatagca

SEQ ID NO: 494 - DNA, 20 bp, Artificial Sequence
  gRNA target sequence
taactagaaataactttgca

SEQ ID NO: 495 - DNA, 20 bp, Artificial Sequence
  gRNA target sequence
ccgtctatgtagcaaaatag

SEQ ID NO: 496 - DNA, 20 bp, Artificial Sequence
  gRNA target sequence
cgtctatgtagcaaaatagt

SEQ ID NO: 497 - DNA, 20 bp, Artificial Sequence
  gRNA target sequence
aaaatagtgggaagatttat

SEQ ID NO: 498 - DNA, 20 bp, Artificial Sequence
  gRNA target sequence
gtgggaagatttataggtag

SEQ ID NO: 499 - DNA, 20 bp, Artificial Sequence
  gRNA target sequence
ggcgacaaacctaccgagcc

SEQ ID NO: 500 - DNA, 20 bp, Artificial Sequence
  gRNA target sequence
ctaccgagcctggtgatagc

SEQ ID NO: 501 - DNA, 20 bp, Artificial Sequence
  gRNA target sequence
atttaactgttagtccaaag

SEQ ID NO: 502 - DNA, 20 bp, Artificial Sequence
  gRNA target sequence
tccaaagaggaacagctctt

SEQ ID NO: 503 - DNA, 20 bp, Artificial Sequence
  gRNA target sequence
ggaacagctctttggacact

SEQ ID NO: 504 - DNA, 20 bp, Artificial Sequence
  gRNA target sequence
aaaaatttaacacccatagt

SEQ ID NO: 505 - DNA, 20 bp, Artificial Sequence
  gRNA target sequence
ctgaactcctcacacccaat

SEQ ID NO: 506 - DNA, 20 bp, Artificial Sequence
  gRNA target sequence
cctcactgtcaacccaacac

SEQ ID NO: 507 - DNA, 20 bp, Artificial Sequence
  gRNA target sequence
ccaacacaggcatgctcata

SEQ ID NO: 508 - DNA, 20 bp, Artificial Sequence
  gRNA target sequence
acaggcatgctcataaggaa

SEQ ID NO: 509 - DNA, 20 bp, Artificial Sequence
  gRNA target sequence
gaaaggttaaaaaaagtaaa

SEQ ID NO: 510 - DNA, 20 bp, Artificial Sequence
  gRNA target sequence
taaaaaaagtaaaaggaact

SEQ ID NO: 511 - DNA, 20 bp, Artificial Sequence
  gRNA target sequence
tctagcatcaccagtattag

SEQ ID NO: 512 - DNA, 20 bp, Artificial Sequence
  gRNA target sequence
gcccagtgacacatgtttaa

SEQ ID NO: 513 - DNA, 20 bp, Artificial Sequence
  gRNA target sequence
tgacacatgtttaacggccg

SEQ ID NO: 514 - DNA, 20 bp, Artificial Sequence
  gRNA target sequence
gcggtaccctaaccgtgcaa

SEQ ID NO: 515 - DNA, 20 bp, Artificial Sequence
  gRNA target sequence
taatcacttgttccttaaat

SEQ ID NO: 516 - DNA, 20 bp, Artificial Sequence
  gRNA target sequence
aatcacttgttccttaaata

SEQ ID NO: 517 - DNA, 20 bp, Artificial Sequence
  gRNA target sequence
taaatagggacctgtatgaa

SEQ ID NO: 518 - DNA, 20 bp, Artificial Sequence
  gRNA target sequence
cctgtatgaatggctccacg

SEQ ID NO: 519 - DNA, 20 bp, Artificial Sequence
  gRNA target sequence
ctgtatgaatggctccacga

SEQ ID NO: 520 - DNA, 20 bp, Artificial Sequence
  gRNA target sequence
aaattgacctgcccgtgaag

SEQ ID NO: 521 - DNA, 20 bp, Artificial Sequence
  gRNA target sequence
ttgacctgcccgtgaagagg

SEQ ID NO: 522 - DNA, 20 bp, Artificial Sequence
  gRNA target sequence
tgacctgcccgtgaagaggc

SEQ ID NO: 523 - DNA, 20 bp, Artificial Sequence
  gRNA target sequence
agcaagacgagaagacccta

SEQ ID NO: 524 - DNA, 20 bp, Artificial Sequence
  gRNA target sequence
acagtacctaacaaacccac

SEQ ID NO: 525 - DNA, 20 bp, Artificial Sequence
  gRNA target sequence
caaacctgcattaaaaattt

SEQ ID NO: 526 - DNA, 20 bp, Artificial Sequence
  gRNA target sequence
cctgcattaaaaatttcggt

SEQ ID NO: 527 - DNA, 20 bp, Artificial Sequence
  gRNA target sequence
ctgcattaaaaatttcggtt

SEQ ID NO: 528 - DNA, 20 bp, Artificial Sequence
  gRNA target sequence
tgcattaaaaatttcggttg

SEQ ID NO: 529 - DNA, 20 bp, Artificial Sequence
  gRNA target sequence
aatttcggttggggcgacct

SEQ ID NO: 530 - DNA, 20 bp, Artificial Sequence
  gRNA target sequence
tgatccaataacttgaccaa

SEQ ID NO: 531 - DNA, 20 bp, Artificial Sequence
  gRNA target sequence
ccaacggaacaagttaccct

SEQ ID NO: 532 - DNA, 20 bp, Artificial Sequence
  gRNA target sequence
caacggaacaagttacccta

SEQ ID NO: 533 - DNA, 20 bp, Artificial Sequence
  gRNA target sequence
ctagagtccatatcaacaat

SEQ ID NO: 534 - DNA, 20 bp, Artificial Sequence
  gRNA target sequence
tagagtccatatcaacaata

SEQ ID NO: 535 - DNA, 20 bp, Artificial Sequence
  gRNA target sequence
agggtttacgacctcgatgt

SEQ ID NO: 536 - DNA, 20 bp, Artificial Sequence
  gRNA target sequence
tacgacctcgatgttggatc

SEQ ID NO: 537 - DNA, 20 bp, Artificial Sequence
  gRNA target sequence
gttggatcaggacatcccga

SEQ ID NO: 538 - DNA, 20 bp, Artificial Sequence
  gRNA target sequence
gatggtgcagccgctattaa

SEQ ID NO: 539 - DNA, 20 bp, Artificial Sequence
  gRNA target sequence
tacgtgatctgagttcagac

SEQ ID NO: 540 - DNA, 20 bp, Artificial Sequence
  gRNA target sequence
agttcagaccggagtaatcc

SEQ ID NO: 541 - DNA, 20 bp, Artificial Sequence
  gRNA target sequence
cagaccggagtaatccaggt

SEQ ID NO: 542 - DNA, 20 bp, Artificial Sequence
  gRNA target sequence
caaattcctccctgtacgaa

SEQ ID NO: 543 - DNA, 20 bp, Artificial Sequence
  gRNA target sequence
acgaaaggacaagagaaata

SEQ ID NO: 544 - DNA, 20 bp, Artificial Sequence
  gRNA target sequence
acccacacccacccaagaac

SEQ ID NO: 545 - DNA, 20 bp, Artificial Sequence
  gRNA target sequence
cccacacccacccaagaaca

SEQ ID NO: 546 - DNA, 20 bp, Artificial Sequence
  gRNA target sequence
aagaacagggtttgttaaga

SEQ ID NO: 547 - DNA, 20 bp, Artificial Sequence
  gRNA target sequence
tttgttaagatggcagagcc

SEQ ID NO: 548 - DNA, 20 bp, Artificial Sequence
  gRNA target sequence
acttaaaactttacagtcag

SEQ ID NO: 549 - DNA, 20 bp, Artificial Sequence
  gRNA target sequence
tcttcttaacaacataccca

SEQ ID NO: 550 - DNA, 20 bp, Artificial Sequence
  gRNA target sequence
tgtacccattctaatcgcaa

SEQ ID NO: 551 - DNA, 20 bp, Artificial Sequence
  gRNA target sequence
cttaccgaacgaaaaattct

SEQ ID NO: 552 - DNA, 20 bp, Artificial Sequence
  gRNA target sequence
ggctatatacaactacgcaa

SEQ ID NO: 553 - DNA, 20 bp, Artificial Sequence
  gRNA target sequence
cgcaaaggccccaacgttgt

SEQ ID NO: 554 - DNA, 20 bp, Artificial Sequence
  gRNA target sequence
cccaacgttgtaggccccta

SEQ ID NO: 555 - DNA, 20 bp, Artificial Sequence
  gRNA target sequence
ccaacgttgtaggcccctac

SEQ ID NO: 556 - DNA, 20 bp, Artificial Sequence
  gRNA target sequence
cctccccatacccaaccccc

SEQ ID NO: 557 - DNA, 20 bp, Artificial Sequence
  gRNA target sequence
cccctggtcaacctcaacct

SEQ ID NO: 558 - DNA, 20 bp, Artificial Sequence
  gRNA target sequence
gtttactcaatcctctgatc

SEQ ID NO: 559 - DNA, 20 bp, Artificial Sequence
  gRNA target sequence
tttactcaatcctctgatca

SEQ ID NO: 560 - DNA, 20 bp, Artificial Sequence
  gRNA target sequence
aactcaaactacgccctgat

SEQ ID NO: 561 - DNA, 20 bp, Artificial Sequence
  gRNA target sequence
ctatcaacattactaataag

SEQ ID NO: 562 - DNA, 20 bp, Artificial Sequence
  gRNA target sequence
actcctgccatcatgaccct

SEQ ID NO: 563 - DNA, 20 bp, Artificial Sequence
  gRNA target sequence
acccccttcgaccttgccga

SEQ ID NO: 564 - DNA, 20 bp, Artificial Sequence
  gRNA target sequence
cccccttcgaccttgccgaa

SEQ ID NO: 565 - DNA, 20 bp, Artificial Sequence
  gRNA target sequence
ccccttcgaccttgccgaag

SEQ ID NO: 566 - DNA, 20 bp, Artificial Sequence
  gRNA target sequence
ggggagtccgaactagtctc

SEQ ID NO: 567 - DNA, 20 bp, Artificial Sequence
  gRNA target sequence
ttcaacatcgaatacgccgc

SEQ ID NO: 568 - DNA, 20 bp, Artificial Sequence
  gRNA target sequence
ctcaccactacaatcttcct

SEQ ID NO: 569 - DNA, 20 bp, Artificial Sequence
  gRNA target sequence
actttgatagagtaaataat

SEQ ID NO: 570 - DNA, 20 bp, Artificial Sequence
  gRNA target sequence
gcttaaacccccttatttct

SEQ ID NO: 571 - DNA, 20 bp, Artificial Sequence
  gRNA target sequence
tcacaccccatcctaaagta

SEQ ID NO: 572 - DNA, 20 bp, Artificial Sequence
  gRNA target sequence
aggtcagctaaataagctat

SEQ ID NO: 573 - DNA, 20 bp, Artificial Sequence
  gRNA target sequence
ggtcagctaaataagctatc

SEQ ID NO: 574 - DNA, 20 bp, Artificial Sequence
  gRNA target sequence
ggcccataccccgaaaatgt

SEQ ID NO: 575 - DNA, 20 bp, Artificial Sequence
  gRNA target sequence
tcccgtactaattaatcccc

SEQ ID NO: 576 - DNA, 20 bp, Artificial Sequence
  gRNA target sequence
atctactctaccatctttgc

SEQ ID NO: 577 - DNA, 20 bp, Artificial Sequence
  gRNA target sequence
cactgattttttacctgagt

SEQ ID NO: 578 - DNA, 20 bp, Artificial Sequence
  gRNA target sequence
ctcttcaacaatatactctc

SEQ ID NO: 579 - DNA, 20 bp, Artificial Sequence
  gRNA target sequence
atagctatagcaataaaact

SEQ ID NO: 580 - DNA, 20 bp, Artificial Sequence
  gRNA target sequence
ctttcacttctgagtcccag

SEQ ID NO: 581 - DNA, 20 bp, Artificial Sequence
  gRNA target sequence
tgagtcccagaggttaccca

SEQ ID NO: 582 - DNA, 20 bp, Artificial Sequence
  gRNA target sequence
caaggcacccctctgacatc

SEQ ID NO: 583 - DNA, 20 bp, Artificial Sequence
  gRNA target sequence
tcaatcttatccatcatagc

SEQ ID NO: 584 - DNA, 20 bp, Artificial Sequence
  gRNA target sequence
tccatcatagcaggcagttg

SEQ ID NO: 585 - DNA, 20 bp, Artificial Sequence
  gRNA target sequence
atcatagcaggcagttgagg

SEQ ID NO: 586 - DNA, 20 bp, Artificial Sequence
  gRNA target sequence
tactcctcaattacccacat

SEQ ID NO: 587 - DNA, 20 bp, Artificial Sequence
  gRNA target sequence
ccatccaccctcctctccct

SEQ ID NO: 588 - DNA, 20 bp, Artificial Sequence
  gRNA target sequence
tccaccctcctctccctagg

SEQ ID NO: 589 - DNA, 20 bp, Artificial Sequence
  gRNA target sequence
ggaggcctgcccccgctaac

SEQ ID NO: 590 - DNA, 20 bp, Artificial Sequence
  gRNA target sequence
taaccggctttttgcccaaa

SEQ ID NO: 591 - DNA, 20 bp, Artificial Sequence
  gRNA target sequence
aaccggctttttgcccaaat

SEQ ID NO: 592 - DNA, 20 bp, Artificial Sequence
  gRNA target sequence
taataatcttatagaaattt

SEQ ID NO: 593 - DNA, 20 bp, Artificial Sequence
  gRNA target sequence
cttaatttctgtaacagcta

SEQ ID NO: 594 - DNA, 20 bp, Artificial Sequence
  gRNA target sequence
ctaagcccttactagaccaa

SEQ ID NO: 595 - DNA, 20 bp, Artificial Sequence
  gRNA target sequence
taagcccttactagaccaat

SEQ ID NO: 596 - DNA, 20 bp, Artificial Sequence
  gRNA target sequence
agctaagcaccctaatcaac

SEQ ID NO: 597 - DNA, 20 bp, Artificial Sequence
  gRNA target sequence
caatctacttctcccgccgc

SEQ ID NO: 598 - DNA, 20 bp, Artificial Sequence
  gRNA target sequence
aatctacttctcccgccgcc

SEQ ID NO: 599 - DNA, 20 bp, Artificial Sequence
  gRNA target sequence
tctcccgccgccgggaaaaa

SEQ ID NO: 600 - DNA, 20 bp, Artificial Sequence
  gRNA target sequence
cccgccgccgggaaaaaagg

SEQ ID NO: 601 - DNA, 20 bp, Artificial Sequence
  gRNA target sequence
ccgccgccgggaaaaaaggc

SEQ ID NO: 602 - DNA, 20 bp, Artificial Sequence
  gRNA target sequence
aaaaaaggcgggagaagccc

SEQ ID NO: 603 - DNA, 20 bp, Artificial Sequence
  gRNA target sequence
aaggcgggagaagccccggc

SEQ ID NO: 604 - DNA, 20 bp, Artificial Sequence
  gRNA target sequence
attcaatatgaaaatcacct

SEQ ID NO: 605 - DNA, 20 bp, Artificial Sequence
  gRNA target sequence
tatgaaaatcacctcggagc

SEQ ID NO: 606 - DNA, 20 bp, Artificial Sequence
  gRNA target sequence
acctcggagctggtaaaaag

SEQ ID NO: 607 - DNA, 20 bp, Artificial Sequence
  gRNA target sequence
tctacaaaccacaaagacat

SEQ ID NO: 608 - DNA, 20 bp, Artificial Sequence
  gRNA target sequence
ggaacactatacctattatt

SEQ ID NO: 609 - DNA, 20 bp, Artificial Sequence
  gRNA target sequence
ctattattcggcgcatgagc

SEQ ID NO: 610 - DNA, 20 bp, Artificial Sequence
  gRNA target sequence
ggcgcatgagctggagtcct

SEQ ID NO: 611 - DNA, 20 bp, Artificial Sequence
  gRNA target sequence
cctccttattcgagccgagc

SEQ ID NO: 612 - DNA, 20 bp, Artificial Sequence
  gRNA target sequence
ctccttattcgagccgagct

SEQ ID NO: 613 - DNA, 20 bp, Artificial Sequence
  gRNA target sequence
ggccagccaggcaaccttct

SEQ ID NO: 614 - DNA, 20 bp, Artificial Sequence
  gRNA target sequence
atagtaatacccatcataat

SEQ ID NO: 615 - DNA, 20 bp, Artificial Sequence
  gRNA target sequence
gtaatacccatcataatcgg

SEQ ID NO: 616 - DNA, 20 bp, Artificial Sequence
  gRNA target sequence
cccatcataatcggaggctt

SEQ ID NO: 617 - DNA, 20 bp, Artificial Sequence
  gRNA target sequence
tgactagttcccctaataat

SEQ ID NO: 618 - DNA, 20 bp, Artificial Sequence
  gRNA target sequence
aataatcggtgcccccgata

SEQ ID NO: 619 - DNA, 20 bp, Artificial Sequence
  gRNA target sequence
cctgctcgcatctgctatag

SEQ ID NO: 620 - DNA, 20 bp, Artificial Sequence
  gRNA target sequence
gctcgcatctgctatagtgg

SEQ ID NO: 621 - DNA, 20 bp, Artificial Sequence
  gRNA target sequence
gcatctgctatagtggaggc

SEQ ID NO: 622 - DNA, 20 bp, Artificial Sequence
  gRNA target sequence
gctatagtggaggccggagc

SEQ ID NO: 623 - DNA, 20 bp, Artificial Sequence
  gRNA target sequence
gtggaggccggagcaggaac

SEQ ID NO: 624 - DNA, 20 bp, Artificial Sequence
  gRNA target sequence
acagtctaccctcccttagc

SEQ ID NO: 625 - DNA, 20 bp, Artificial Sequence
  gRNA target sequence
cagtctaccctcccttagca

SEQ ID NO: 626 - DNA, 20 bp, Artificial Sequence
  gRNA target sequence
gcagggaactactcccaccc

SEQ ID NO: 627 - DNA, 20 bp, Artificial Sequence
  gRNA target sequence
atcttctccttacacctagc

SEQ ID NO: 628 - DNA, 20 bp, Artificial Sequence
  gRNA target sequence
gcaggtgtctcctctatctt

SEQ ID NO: 629 - DNA, 20 bp, Artificial Sequence
  gRNA target sequence
caggtgtctcctctatctta

SEQ ID NO: 630 - DNA, 20 bp, Artificial Sequence
  gRNA target sequence
aggtgtctcctctatcttag

SEQ ID NO: 631 - DNA, 20 bp, Artificial Sequence
  gRNA target sequence
tctctcccagtcctagctgc

SEQ ID NO: 632 - DNA, 20 bp, Artificial Sequence
  gRNA target sequence
accaccttcttcgaccccgc

SEQ ID NO: 633 - DNA, 20 bp, Artificial Sequence
  gRNA target sequence
accttcttcgaccccgccgg

SEQ ID NO: 634 - DNA, 20 bp, Artificial Sequence
  gRNA target sequence
ttcttcgaccccgccggagg

SEQ ID NO: 635 - DNA, 20 bp, Artificial Sequence
  gRNA target sequence
caacacctattctgattttt

SEQ ID NO: 636 - DNA, 20 bp, Artificial Sequence
  gRNA target sequence
gtttatattcttatcctacc

SEQ ID NO: 637 - DNA, 20 bp, Artificial Sequence
  gRNA target sequence
attcttatcctaccaggctt

SEQ ID NO: 638 - DNA, 20 bp, Artificial Sequence
  gRNA target sequence
catattgtaacttactactc

SEQ ID NO: 639 - DNA, 20 bp, Artificial Sequence
  gRNA target sequence
tccggaaaaaaagaaccatt

SEQ ID NO: 640 - DNA, 20 bp, Artificial Sequence
  gRNA target sequence
aaagaaccatttggatacat

SEQ ID NO: 641 - DNA, 20 bp, Artificial Sequence
  gRNA target sequence
accatttggatacataggta

SEQ ID NO: 642 - DNA, 20 bp, Artificial Sequence
  gRNA target sequence
gtctgagctatgatatcaat

SEQ ID NO: 643 - DNA, 20 bp, Artificial Sequence
  gRNA target sequence
atgatatcaattggcttcct

SEQ ID NO: 644 - DNA, 20 bp, Artificial Sequence
  gRNA target sequence
tgatatcaattggcttccta

SEQ ID NO: 645 - DNA, 20 bp, Artificial Sequence
  gRNA target sequence
gcacaccatatatttacagt

SEQ ID NO: 646 - DNA, 20 bp, Artificial Sequence
  gRNA target sequence
ataatcatcgctatccccac

SEQ ID NO: 647 - DNA, 20 bp, Artificial Sequence
  gRNA target sequence
agctgactcgccacactcca

SEQ ID NO: 648 - DNA, 20 bp, Artificial Sequence
  gRNA target sequence
gctgcagtgctctgagccct

SEQ ID NO: 649 - DNA, 20 bp, Artificial Sequence
  gRNA target sequence
ttcatctttcttttcaccgt

SEQ ID NO: 650 - DNA, 20 bp, Artificial Sequence
  gRNA target sequence
atctttcttttcaccgtagg

SEQ ID NO: 651 - DNA, 20 bp, Artificial Sequence
  gRNA target sequence
ttcaccgtaggtggcctgac

SEQ ID NO: 652 - DNA, 20 bp, Artificial Sequence
  gRNA target sequence
ttccactatgtcctatcaat

SEQ ID NO: 653 - DNA, 20 bp, Artificial Sequence
  gRNA target sequence
ggagctgtatttgccatcat

SEQ ID NO: 654 - DNA, 20 bp, Artificial Sequence
  gRNA target sequence
gctgtatttgccatcatagg

SEQ ID NO: 655 - DNA, 20 bp, Artificial Sequence
  gRNA target sequence
cactgatttcccctattctc

SEQ ID NO: 656 - DNA, 20 bp, Artificial Sequence
  gRNA target sequence
catttcactatcatattcat

SEQ ID NO: 657 - DNA, 20 bp, Artificial Sequence
  gRNA target sequence
ttcttcccacaacactttct

SEQ ID NO: 658 - DNA, 20 bp, Artificial Sequence
  gRNA target sequence
caacactttctcggcctatc

SEQ ID NO: 659 - DNA, 20 bp, Artificial Sequence
  gRNA target sequence
cggaatgccccgacgttact

SEQ ID NO: 660 - DNA, 20 bp, Artificial Sequence
  gRNA target sequence
tgaaacatcctatcatctgt

SEQ ID NO: 661 - DNA, 20 bp, Artificial Sequence
  gRNA target sequence
agaagaaccctccataaacc

SEQ ID NO: 662 - DNA, 20 bp, Artificial Sequence
  gRNA target sequence
ataaacctggagtgactata

SEQ ID NO: 663 - DNA, 20 bp, Artificial Sequence
  gRNA target sequence
acataaaatctagacaaaaa

SEQ ID NO: 664 - DNA, 20 bp, Artificial Sequence
  gRNA target sequence
aaaatctagacaaaaaagga

SEQ ID NO: 665 - DNA, 20 bp, Artificial Sequence
  gRNA target sequence
ggaatcgaaccccccaaagc

SEQ ID NO: 666 - DNA, 20 bp, Artificial Sequence
  gRNA target sequence
ctggtttcaagccaacccca

SEQ ID NO: 667 - DNA, 20 bp, Artificial Sequence
  gRNA target sequence
cctccatgactttttcaaaa

SEQ ID NO: 668 - DNA, 20 bp, Artificial Sequence
  gRNA target sequence
ctttgtcaaagttaaattat

SEQ ID NO: 669 - DNA, 20 bp, Artificial Sequence
  gRNA target sequence
ctaaatcctatatatcttaa

SEQ ID NO: 670 - DNA, 20 bp, Artificial Sequence
  gRNA target sequence
atggcacatgcagcgcaagt

SEQ ID NO: 671 - DNA, 20 bp, Artificial Sequence
  gRNA target sequence
tactaacatctcagacgctc

SEQ ID NO: 672 - DNA, 20 bp, Artificial Sequence
  gRNA target sequence
catcctttacataacagacg

SEQ ID NO: 673 - DNA, 20 bp, Artificial Sequence
  gRNA target sequence
tcccttaccatcaaatcaat

SEQ ID NO: 674 - DNA, 20 bp, Artificial Sequence
  gRNA target sequence
tcaaatcaattggccaccaa

SEQ ID NO: 675 - DNA, 20 bp, Artificial Sequence
  gRNA target sequence
acctacgagtacaccgacta

SEQ ID NO: 676 - DNA, 20 bp, Artificial Sequence
  gRNA target sequence
tacgagtacaccgactacgg

SEQ ID NO: 677 - DNA, 20 bp, Artificial Sequence
  gRNA target sequence
cccccattattcctagaacc

SEQ ID NO: 678 - DNA, 20 bp, Artificial Sequence
  gRNA target sequence
tcatgagctgtccccacatt

SEQ ID NO: 679 - DNA, 20 bp, Artificial Sequence
  gRNA target sequence
ttaaaaacagatgcaattcc

SEQ ID NO: 680 - DNA, 20 bp, Artificial Sequence
  gRNA target sequence
cactttcaccgctacacgac

SEQ ID NO: 681 - DNA, 20 bp, Artificial Sequence
  gRNA target sequence
actttcaccgctacacgacc

SEQ ID NO: 682 - DNA, 20 bp, Artificial Sequence
  gRNA target sequence
ctttcaccgctacacgaccg

SEQ ID NO: 683 - DNA, 20 bp, Artificial Sequence
  gRNA target sequence
tttcaccgctacacgaccgg

SEQ ID NO: 684 - DNA, 20 bp, Artificial Sequence
  gRNA target sequence
acacgaccgggggtatacta

SEQ ID NO: 685 - DNA, 20 bp, Artificial Sequence
  gRNA target sequence
ggtcaatgctctgaaatctg

SEQ ID NO: 686 - DNA, 20 bp, Artificial Sequence
  gRNA target sequence
cccctaaaaatctttgaaat

SEQ ID NO: 687 - DNA, 20 bp, Artificial Sequence
  gRNA target sequence
ccctaaaaatctttgaaata

SEQ ID NO: 688 - DNA, 20 bp, Artificial Sequence
  gRNA target sequence
cccaactaaatactaccgta

SEQ ID NO: 689 - DNA, 20 bp, Artificial Sequence
  gRNA target sequence
ttcattgcccccacaatcct

SEQ ID NO: 690 - DNA, 20 bp, Artificial Sequence
  gRNA target sequence
ataaccatacacaacactaa

SEQ ID NO: 691 - DNA, 20 bp, Artificial Sequence
  gRNA target sequence
attgccacaactaacctcct

SEQ ID NO: 692 - DNA, 20 bp, Artificial Sequence
  gRNA target sequence
actatctataaacctagcca

SEQ ID NO: 693 - DNA, 20 bp, Artificial Sequence
  gRNA target sequence
catggccatccccttatgag

SEQ ID NO: 694 - DNA, 20 bp, Artificial Sequence
  gRNA target sequence
atggccatccccttatgagc

SEQ ID NO: 695 - DNA, 20 bp, Artificial Sequence
  gRNA target sequence
tgagcgggcacagtgattat

SEQ ID NO: 696 - DNA, 20 bp, Artificial Sequence
  gRNA target sequence
ctagcccacttcttaccaca

SEQ ID NO: 697 - DNA, 20 bp, Artificial Sequence
  gRNA target sequence
actcattcaaccaatagccc

SEQ ID NO: 698 - DNA, 20 bp, Artificial Sequence
  gRNA target sequence
ctaaccgctaacattactgc

SEQ ID NO: 699 - DNA, 20 bp, Artificial Sequence
  gRNA target sequence
cacctactcatgcacctaat

SEQ ID NO: 700 - DNA, 20 bp, Artificial Sequence
  gRNA target sequence
cccagcccatgacccctaac

SEQ ID NO: 701 - DNA, 20 bp, Artificial Sequence
  gRNA target sequence
ccagcccatgacccctaaca

SEQ ID NO: 702 - DNA, 20 bp, Artificial Sequence
  gRNA target sequence
cagcccatgacccctaacag

SEQ ID NO: 703 - DNA, 20 bp, Artificial Sequence
  gRNA target sequence
tcagccctcctaatgacctc

SEQ ID NO: 704 - DNA, 20 bp, Artificial Sequence
  gRNA target sequence
tccataacgctcctcatact

SEQ ID NO: 705 - DNA, 20 bp, Artificial Sequence
  gRNA target sequence
cactaaccatataccaatga

SEQ ID NO: 706 - DNA, 20 bp, Artificial Sequence
  gRNA target sequence
acacgagaaagcacatacca

SEQ ID NO: 707 - DNA, 20 bp, Artificial Sequence
  gRNA target sequence
cacacaccacctgtccaaaa

SEQ ID NO: 708 - DNA, 20 bp, Artificial Sequence
  gRNA target sequence
gtccaaaaaggccttcgata

SEQ ID NO: 709 - DNA, 20 bp, Artificial Sequence
  gRNA target sequence
tccaaaaaggccttcgatac

SEQ ID NO: 710 - DNA, 20 bp, Artificial Sequence
  gRNA target sequence
tcagaagtttttttcttcgc

SEQ ID NO: 711 - DNA, 20 bp, Artificial Sequence
  gRNA target sequence
ctagcccctaccccccaatt

SEQ ID NO: 712 - DNA, 20 bp, Artificial Sequence
  gRNA target sequence
gcccctaccccccaattagg

SEQ ID NO: 713 - DNA, 20 bp, Artificial Sequence
  gRNA target sequence
cccctaccccccaattagga

SEQ ID NO: 714 - DNA, 20 bp, Artificial Sequence
  gRNA target sequence
ccccccaattaggagggcac

SEQ ID NO: 715 - DNA, 20 bp, Artificial Sequence
  gRNA target sequence
ggagggcactggcccccaac

SEQ ID NO: 716 - DNA, 20 bp, Artificial Sequence
  gRNA target sequence
acatccgtattactcgcatc

SEQ ID NO: 717 - DNA, 20 bp, Artificial Sequence
  gRNA target sequence
actgcttattacaattttac

SEQ ID NO: 718 - DNA, 20 bp, Artificial Sequence
  gRNA target sequence
ctgcttattacaattttact

SEQ ID NO: 719 - DNA, 20 bp, Artificial Sequence
  gRNA target sequence
tctcccttcaccatttccga

SEQ ID NO: 720 - DNA, 20 bp, Artificial Sequence
  gRNA target sequence
accatttccgacggcatcta

SEQ ID NO: 721 - DNA, 20 bp, Artificial Sequence
  gRNA target sequence
tcaacattttttgtagccac

SEQ ID NO: 722 - DNA, 20 bp, Artificial Sequence
  gRNA target sequence
tttgtagccacaggcttcca

SEQ ID NO: 723 - DNA, 20 bp, Artificial Sequence
  gRNA target sequence
cacggacttcacgtcattat

SEQ ID NO: 724 - DNA, 20 bp, Artificial Sequence
  gRNA target sequence
tttacatccaaacatcactt

SEQ ID NO: 725 - DNA, 20 bp, Artificial Sequence
  gRNA target sequence
tcgaagccgccgcctgatac

SEQ ID NO: 726 - DNA, 20 bp, Artificial Sequence
  gRNA target sequence
atactggcattttgtagatg

SEQ ID NO: 727 - DNA, 20 bp, Artificial Sequence
  gRNA target sequence
tatgtctccatctattgatg

SEQ ID NO: 728 - DNA, 20 bp, Artificial Sequence
  gRNA target sequence
atgtctccatctattgatga

SEQ ID NO: 729 - DNA, 20 bp, Artificial Sequence
  gRNA target sequence
ttttgactaccacaactcaa

SEQ ID NO: 730 - DNA, 20 bp, Artificial Sequence
  gRNA target sequence
aaatccaccccttacgagtg

SEQ ID NO: 731 - DNA, 20 bp, Artificial Sequence
  gRNA target sequence
catcatcctagccctaagtc

SEQ ID NO: 732 - DNA, 20 bp, Artificial Sequence
  gRNA target sequence
gcctatgagtgactacaaaa

SEQ ID NO: 733 - DNA, 20 bp, Artificial Sequence
  gRNA target sequence
aggattagactgaaccgaat

SEQ ID NO: 734 - DNA, 20 bp, Artificial Sequence
  gRNA target sequence
gcatttaccatctcacttct

SEQ ID NO: 735 - DNA, 20 bp, Artificial Sequence
  gRNA target sequence
tcctccctactatgcctaga

SEQ ID NO: 736 - DNA, 20 bp, Artificial Sequence
  gRNA target sequence
ctttgccgcctgcgaagcag

SEQ ID NO: 737 - DNA, 20 bp, Artificial Sequence
  gRNA target sequence
tgccgcctgcgaagcagcgg

SEQ ID NO: 738 - DNA, 20 bp, Artificial Sequence
  gRNA target sequence
gccgcctgcgaagcagcggt

SEQ ID NO: 739 - DNA, 20 bp, Artificial Sequence
  gRNA target sequence
gtctcaatctccaacacata

SEQ ID NO: 740 - DNA, 20 bp, Artificial Sequence
  gRNA target sequence
actcctacccctcacaatca

SEQ ID NO: 741 - DNA, 20 bp, Artificial Sequence
  gRNA target sequence
aaccacacttatccccacct

SEQ ID NO: 742 - DNA, 20 bp, Artificial Sequence
  gRNA target sequence
ttggctatcatcacccgatg

SEQ ID NO: 743 - DNA, 20 bp, Artificial Sequence
  gRNA target sequence
cagccagaacgcctgaacgc

SEQ ID NO: 744 - DNA, 20 bp, Artificial Sequence
  gRNA target sequence
ttcctattctacaccctagt

SEQ ID NO: 745 - DNA, 20 bp, Artificial Sequence
  gRNA target sequence
atttacactcacaacaccct

SEQ ID NO: 746 - DNA, 20 bp, Artificial Sequence
  gRNA target sequence
atagtaaagatacctcttta

SEQ ID NO: 747 - DNA, 20 bp, Artificial Sequence
  gRNA target sequence
catgtcgaagcccccatcgc

SEQ ID NO: 748 - DNA, 20 bp, Artificial Sequence
  gRNA target sequence
atgtcgaagcccccatcgct

SEQ ID NO: 749 - DNA, 20 bp, Artificial Sequence
  gRNA target sequence
gccgcagtactcttaaaact

SEQ ID NO: 750 - DNA, 20 bp, Artificial Sequence
  gRNA target sequence
gcagtactcttaaaactagg

SEQ ID NO: 751 - DNA, 20 bp, Artificial Sequence
  gRNA target sequence
ctcttaaaactaggcggcta

SEQ ID NO: 752 - DNA, 20 bp, Artificial Sequence
  gRNA target sequence
ttccttgtactatccctatg

SEQ ID NO: 753 - DNA, 20 bp, Artificial Sequence
  gRNA target sequence
caaaccccctgaagcttcac

SEQ ID NO: 754 - DNA, 20 bp, Artificial Sequence
  gRNA target sequence
gtcattctcataatcgccca

SEQ ID NO: 755 - DNA, 20 bp, Artificial Sequence
  gRNA target sequence
tcattctcataatcgcccac

SEQ ID NO: 756 - DNA, 20 bp, Artificial Sequence
  gRNA target sequence
cgcatcataatcctctctca

SEQ ID NO: 757 - DNA, 20 bp, Artificial Sequence
  gRNA target sequence
accccccactattaacctac

SEQ ID NO: 758 - DNA, 20 bp, Artificial Sequence
  gRNA target sequence
ccccccactattaacctact

SEQ ID NO: 759 - DNA, 20 bp, Artificial Sequence
  gRNA target sequence
aatatcactctcctacttac

SEQ ID NO: 760 - DNA, 20 bp, Artificial Sequence
  gRNA target sequence
acatatttaccacaacacaa

SEQ ID NO: 761 - DNA, 20 bp, Artificial Sequence
  gRNA target sequence
catatttaccacaacacaat

SEQ ID NO: 762 - DNA, 20 bp, Artificial Sequence
  gRNA target sequence
atatttaccacaacacaatg

SEQ ID NO: 763 - DNA, 20 bp, Artificial Sequence
  gRNA target sequence
ctcaaccccgacatcattac

SEQ ID NO: 764 - DNA, 20 bp, Artificial Sequence
  gRNA target sequence
tcaaccccgacatcattacc

SEQ ID NO: 765 - DNA, 20 bp, Artificial Sequence
  gRNA target sequence
gattgtgaatctgacaacag

SEQ ID NO: 766 - DNA, 20 bp, Artificial Sequence
  gRNA target sequence
tgcccccatgtctaacaaca

SEQ ID NO: 767 - DNA, 20 bp, Artificial Sequence
  gRNA target sequence
atggctttctcaacttttaa

SEQ ID NO: 768 - DNA, 20 bp, Artificial Sequence
  gRNA target sequence
aaaggataacagctatccat

SEQ ID NO: 769 - DNA, 20 bp, Artificial Sequence
  gRNA target sequence
aacagctatccattggtctt

SEQ ID NO: 770 - DNA, 20 bp, Artificial Sequence
  gRNA target sequence
gtcttaggccccaaaaattt

SEQ ID NO: 771 - DNA, 20 bp, Artificial Sequence
  gRNA target sequence
ctgtagcattgttcgttaca

SEQ ID NO: 772 - DNA, 20 bp, Artificial Sequence
  gRNA target sequence
aacctattccaactgttcat

SEQ ID NO: 773 - DNA, 20 bp, Artificial Sequence
  gRNA target sequence
ccaactgttcatcggctgag

SEQ ID NO: 774 - DNA, 20 bp, Artificial Sequence
  gRNA target sequence
caactgttcatcggctgaga

SEQ ID NO: 775 - DNA, 20 bp, Artificial Sequence
  gRNA target sequence
ttcatcggctgagagggcgt

SEQ ID NO: 776 - DNA, 20 bp, Artificial Sequence
  gRNA target sequence
gcaatcctatacaaccgtat

SEQ ID NO: 777 - DNA, 20 bp, Artificial Sequence
  gRNA target sequence
tacaaccgtatcggcgatat

SEQ ID NO: 778 - DNA, 20 bp, Artificial Sequence
  gRNA target sequence
ccaagcctcaccccactact

SEQ ID NO: 779 - DNA, 20 bp, Artificial Sequence
  gRNA target sequence
ggcctcctcctagcagcagc

SEQ ID NO: 780 - DNA, 20 bp, Artificial Sequence
  gRNA target sequence
gcaggcaaatcagcccaatt

SEQ ID NO: 781 - DNA, 20 bp, Artificial Sequence
  gRNA target sequence
tgactcccctcagccataga

SEQ ID NO: 782 - DNA, 20 bp, Artificial Sequence
  gRNA target sequence
tcaagcactatagttgtagc

SEQ ID NO: 783 - DNA, 20 bp, Artificial Sequence
  gRNA target sequence
caaactctaacactatgctt

SEQ ID NO: 784 - DNA, 20 bp, Artificial Sequence
  gRNA target sequence
ttctccacttcaagtcaact

SEQ ID NO: 785 - DNA, 20 bp, Artificial Sequence
  gRNA target sequence
ggactcataatagttacaat

SEQ ID NO: 786 - DNA, 20 bp, Artificial Sequence
  gRNA target sequence
gccatactatttatgtgctc

SEQ ID NO: 787 - DNA, 20 bp, Artificial Sequence
  gRNA target sequence
ccatactatttatgtgctcc

SEQ ID NO: 788 - DNA, 20 bp, Artificial Sequence
  gRNA target sequence
gaacaagatattcgaaaaat

SEQ ID NO: 789 - DNA, 20 bp, Artificial Sequence
  gRNA target sequence
caagatattcgaaaaatagg

SEQ ID NO: 790 - DNA, 20 bp, Artificial Sequence
  gRNA target sequence
acttcaacctccctcaccat

SEQ ID NO: 791 - DNA, 20 bp, Artificial Sequence
  gRNA target sequence
attggcagcctagcattagc

SEQ ID NO: 792 - DNA, 20 bp, Artificial Sequence
  gRNA target sequence
gcaggaatacctttcctcac

SEQ ID NO: 793 - DNA, 20 bp, Artificial Sequence
  gRNA target sequence
ataattcttctcaccctaac

SEQ ID NO: 794 - DNA, 20 bp, Artificial Sequence
  gRNA target sequence
actaaaccccattaaacgcc

SEQ ID NO: 795 - DNA, 20 bp, Artificial Sequence
  gRNA target sequence
cccattaaacgcctggcagc

SEQ ID NO: 796 - DNA, 20 bp, Artificial Sequence
  gRNA target sequence
gcagccggaagcctattcgc

SEQ ID NO: 797 - DNA, 20 bp, Artificial Sequence
  gRNA target sequence
gccctcgctgtcactttcct

SEQ ID NO: 798 - DNA, 20 bp, Artificial Sequence
  gRNA target sequence
ttttatttctccaacatact

SEQ ID NO: 799 - DNA, 20 bp, Artificial Sequence
  gRNA target sequence
caccgcacaatcccctatct

SEQ ID NO: 800 - DNA, 20 bp, Artificial Sequence
  gRNA target sequence
atcatcacctcaacccaaaa

SEQ ID NO: 801 - DNA, 20 bp, Artificial Sequence
  gRNA target sequence
tacaaagcccccgcaccaat

SEQ ID NO: 802 - DNA, 20 bp, Artificial Sequence
  gRNA target sequence
acccctgacccccatgcctc

SEQ ID NO: 803 - DNA, 20 bp, Artificial Sequence
  gRNA target sequence
aatactaaacccccataaat

SEQ ID NO: 804 - DNA, 20 bp, Artificial Sequence
  gRNA target sequence
aaacccccataaataggaga

SEQ ID NO: 805 - DNA, 20 bp, Artificial Sequence
  gRNA target sequence
catacatcattattctcgca

SEQ ID NO: 806 - DNA, 20 bp, Artificial Sequence
  gRNA target sequence
atctccgcatgatgaaactt

SEQ ID NO: 807 - DNA, 20 bp, Artificial Sequence
  gRNA target sequence
tgaaacttcggctcactcct

SEQ ID NO: 808 - DNA, 20 bp, Artificial Sequence
  gRNA target sequence
ctgatcctccaaatcaccac

SEQ ID NO: 809 - DNA, 20 bp, Artificial Sequence
  gRNA target sequence
atcactcgagacgtaaatta

SEQ ID NO: 810 - DNA, 20 bp, Artificial Sequence
  gRNA target sequence
atccgctaccttcacgccaa

SEQ ID NO: 811 - DNA, 20 bp, Artificial Sequence
  gRNA target sequence
atctgcctcttcctacacat

SEQ ID NO: 812 - DNA, 20 bp, Artificial Sequence
  gRNA target sequence
tctgcctcttcctacacatc

SEQ ID NO: 813 - DNA, 20 bp, Artificial Sequence
  gRNA target sequence
ctcttcctacacatcgggcg

SEQ ID NO: 814 - DNA, 20 bp, Artificial Sequence
  gRNA target sequence
atcgggcgaggcctatatta

SEQ ID NO: 815 - DNA, 20 bp, Artificial Sequence
  gRNA target sequence
tactcagaaacctgaaacat

SEQ ID NO: 816 - DNA, 20 bp, Artificial Sequence
  gRNA target sequence
actatagcaacagccttcat

SEQ ID NO: 817 - DNA, 20 bp, Artificial Sequence
  gRNA target sequence
ataggctatgtcctcccgtg

SEQ ID NO: 818 - DNA, 20 bp, Artificial Sequence
  gRNA target sequence
tgaggccaaatatcattctg

SEQ ID NO: 819 - DNA, 20 bp, Artificial Sequence
  gRNA target sequence
gaggccaaatatcattctga

SEQ ID NO: 820 - DNA, 20 bp, Artificial Sequence
  gRNA target sequence
aggccaaatatcattctgag

SEQ ID NO: 821 - DNA, 20 bp, Artificial Sequence
  gRNA target sequence
ctatccgccatcccatacat

SEQ ID NO: 822 - DNA, 20 bp, Artificial Sequence
  gRNA target sequence
tatccgccatcccatacatt

SEQ ID NO: 823 - DNA, 20 bp, Artificial Sequence
  gRNA target sequence
gacctagttcaatgaatctg

SEQ ID NO: 824 - DNA, 20 bp, Artificial Sequence
  gRNA target sequence
ctagttcaatgaatctgagg

SEQ ID NO: 825 - DNA, 20 bp, Artificial Sequence
  gRNA target sequence
cctcctattcttgcacgaaa

SEQ ID NO: 826 - DNA, 20 bp, Artificial Sequence
  gRNA target sequence
ctcctattcttgcacgaaac

SEQ ID NO: 827 - DNA, 20 bp, Artificial Sequence
  gRNA target sequence
acgggatcaaacaaccccct

SEQ ID NO: 828 - DNA, 20 bp, Artificial Sequence
  gRNA target sequence
tacacaatcaaagacgccct

SEQ ID NO: 829 - DNA, 20 bp, Artificial Sequence
  gRNA target sequence
ctattctcaccagacctcct

SEQ ID NO: 830 - DNA, 20 bp, Artificial Sequence
  gRNA target sequence
cgatccgtccctaacaaact

SEQ ID NO: 831 - DNA, 20 bp, Artificial Sequence
  gRNA target sequence
tccgtccctaacaaactagg

SEQ ID NO: 832 - DNA, 20 bp, Artificial Sequence
  gRNA target sequence
ctcctcattctaacctgaat

SEQ ID NO: 833 - DNA, 20 bp, Artificial Sequence
  gRNA target sequence
ctcattctaacctgaatcgg

SEQ ID NO: 834 - DNA, 20 bp, Artificial Sequence
  gRNA target sequence
agctacccttttaccatcat

SEQ ID NO: 835 - DNA, 20 bp, Artificial Sequence
  gRNA target sequence
ttgaaaacaaaatactcaaa

SEQ ID NO: 836 - DNA, 20 bp, Artificial Sequence
  gRNA target sequence
tgaaaacaaaatactcaaat

SEQ ID NO: 837 - DNA, 20 bp, Artificial Sequence
  gRNA target sequence
aatacaccagtcttgtaaac

SEQ ID NO: 838 - DNA, 20 bp, Artificial Sequence
  gRNA target sequence
gagatgaaaacctttttcca

SEQ ID NO: 839 - DNA, 20 bp, Artificial Sequence
  gRNA target sequence
aactattctctgttctttca

SEQ ID NO: 840 - DNA, 20 bp, Artificial Sequence
  gRNA target sequence
actattctctgttctttcat

SEQ ID NO: 841 - DNA, 20 bp, Artificial Sequence
  gRNA target sequence
ctattctctgttctttcatg

SEQ ID NO: 842 - DNA, 20 bp, Artificial Sequence
  gRNA target sequence
ctttcatggggaagcagatt

SEQ ID NO: 843 - DNA, 20 bp, Artificial Sequence
  gRNA target sequence
tttcatggggaagcagattt

SEQ ID NO: 844 - DNA, 20 bp, Artificial Sequence
  gRNA target sequence
cagccaccatgaatattgta

SEQ ID NO: 845 - DNA, 20 bp, Artificial Sequence
  gRNA target sequence
aaagccacccctcacccact

SEQ ID NO: 846 - DNA, 20 bp, Artificial Sequence
  gRNA target sequence
caaatcccttctcgtcccca

SEQ ID NO: 847 - DNA, 20 bp, Artificial Sequence
  gRNA target sequence
atggatgacccccctcagat

SEQ ID NO: 848 - DNA, 20 bp, Artificial Sequence
  gRNA target sequence
tggatgacccccctcagata

SEQ ID NO: 849 - DNA, 20 bp, Artificial Sequence
  gRNA target sequence
ggatgacccccctcagatag

SEQ ID NO: 850 - DNA, 20 bp, Artificial Sequence
  gRNA target sequence
gagtgctactctcctcgctc

SEQ ID NO: 851 - DNA, 20 bp, Artificial Sequence
  gRNA target sequence
agtgctactctcctcgctcc

SEQ ID NO: 852 - DNA, 20 bp, Artificial Sequence
  gRNA target sequence
cgctccgggcccataacact

SEQ ID NO: 853 - DNA, 20 bp, Artificial Sequence
  gRNA target sequence
gctccgggcccataacactt

SEQ ID NO: 854 - DNA, 20 bp, Artificial Sequence
  gRNA target sequence
ctccgggcccataacacttg

SEQ ID NO: 855 - DNA, 20 bp, Artificial Sequence
  gRNA target sequence
tccgggcccataacacttgg

SEQ ID NO: 856 - DNA, 20 bp, Artificial Sequence
  gRNA target sequence
agtgaactgtatccgacatc

SEQ ID NO: 857 - DNA, 20 bp, Artificial Sequence
  gRNA target sequence
cgacatctggttcctacttc

SEQ ID NO: 858 - DNA, 20 bp, Artificial Sequence
  gRNA target sequence
gacatctggttcctacttca

SEQ ID NO: 859 - DNA, 23 bp, Artificial Sequence
  gRNA target sequence
ccctattaaccactcacgggagc

SEQ ID NO: 860 - DNA, 23 bp, Artificial Sequence
  gRNA target sequence
cctattaaccactcacgggagct

SEQ ID NO: 861 - DNA, 23 bp, Artificial Sequence
  gRNA target sequence
ccactcacgggagctctccatgc

SEQ ID NO: 862 - DNA, 23 bp, Artificial Sequence
  gRNA target sequence
ccatgcatttggtattttcgtct

SEQ ID NO: 863 - DNA, 23 bp, Artificial Sequence
  gRNA target sequence
ccggagcaccctatgtcgcagta

SEQ ID NO: 864 - DNA, 23 bp, Artificial Sequence
  gRNA target sequence
ccctatgtcgcagtatctgtctt

SEQ ID NO: 865 - DNA, 23 bp, Artificial Sequence
  gRNA target sequence
cctatgtcgcagtatctgtcttt

SEQ ID NO: 866 - DNA, 23 bp, Artificial Sequence
  gRNA target sequence
cctgcctcatcctattatttatc

SEQ ID NO: 867 - DNA, 23 bp, Artificial Sequence
  gRNA target sequence
cctcatcctattatttatcgcac

SEQ ID NO: 868 - DNA, 23 bp, Artificial Sequence
  gRNA target sequence
cctattatttatcgcacctacgt

SEQ ID NO: 869 - DNA, 23 bp, Artificial Sequence
  gRNA target sequence
cctacgttcaatattacaggcga

SEQ ID NO: 870 - DNA, 23 bp, Artificial Sequence
  gRNA target sequence
ccactttccacacagacatcata

SEQ ID NO: 871 - DNA, 23 bp, Artificial Sequence
  gRNA target sequence
ccacacagacatcataacaaaaa

SEQ ID NO: 872 - DNA, 23 bp, Artificial Sequence
  gRNA target sequence
ccaaaccccccctcccccgcttc

SEQ ID NO: 873 - DNA, 23 bp, Artificial Sequence
  gRNA target sequence
cccccctcccccgcttctggcca

SEQ ID NO: 874 - DNA, 23 bp, Artificial Sequence
  gRNA target sequence
ccccctcccccgcttctggccac

SEQ ID NO: 875 - DNA, 23 bp, Artificial Sequence
  gRNA target sequence
cccctcccccgcttctggccaca

SEQ ID NO: 876 - DNA, 23 bp, Artificial Sequence
  gRNA target sequence
ccctcccccgcttctggccacag

SEQ ID NO: 877 - DNA, 23 bp, Artificial Sequence
  gRNA target sequence
cctcccccgcttctggccacagc

SEQ ID NO: 878 - DNA, 23 bp, Artificial Sequence
  gRNA target sequence
cccccgcttctggccacagcact

SEQ ID NO: 879 - DNA, 23 bp, Artificial Sequence
  gRNA target sequence
ccccgcttctggccacagcactt

SEQ ID NO: 880 - DNA, 23 bp, Artificial Sequence
  gRNA target sequence
cccgcttctggccacagcactta

SEQ ID NO: 881 - DNA, 23 bp, Artificial Sequence
  gRNA target sequence
ccgcttctggccacagcacttaa

SEQ ID NO: 882 - DNA, 23 bp, Artificial Sequence
  gRNA target sequence
ccacagcacttaaacacatctct

SEQ ID NO: 883 - DNA, 23 bp, Artificial Sequence
  gRNA target sequence
ccaaaccccaaaaacaaagaacc

SEQ ID NO: 884 - DNA, 23 bp, Artificial Sequence
  gRNA target sequence
ccccaaaaacaaagaaccctaac

SEQ ID NO: 885 - DNA, 23 bp, Artificial Sequence
  gRNA target sequence
cccaaaaacaaagaaccctaaca

SEQ ID NO: 886 - DNA, 23 bp, Artificial Sequence
  gRNA target sequence
ccaaaaacaaagaaccctaacac

SEQ ID NO: 887 - DNA, 23 bp, Artificial Sequence
  gRNA target sequence
ccctaacaccagcctaaccagat

SEQ ID NO: 888 - DNA, 23 bp, Artificial Sequence
  gRNA target sequence
cctaacaccagcctaaccagatt

SEQ ID NO: 889 - DNA, 23 bp, Artificial Sequence
  gRNA target sequence
ccagcctaaccagatttcaaatt

SEQ ID NO: 890 - DNA, 23 bp, Artificial Sequence
  gRNA target sequence
cctaaccagatttcaaattttat

SEQ ID NO: 891 - DNA, 23 bp, Artificial Sequence
  gRNA target sequence
ccagatttcaaattttatctttt

SEQ ID NO: 892 - DNA, 23 bp, Artificial Sequence
  gRNA target sequence
ccccccaactaacacattatttt

SEQ ID NO: 893 - DNA, 23 bp, Artificial Sequence
  gRNA target sequence
cccccaactaacacattattttc

SEQ ID NO: 894 - DNA, 23 bp, Artificial Sequence
  gRNA target sequence
ccccaactaacacattattttcc

SEQ ID NO: 895 - DNA, 23 bp, Artificial Sequence
  gRNA target sequence
cccaactaacacattattttccc

SEQ ID NO: 896 - DNA, 23 bp, Artificial Sequence
  gRNA target sequence
ccaactaacacattattttcccc

SEQ ID NO: 897 - DNA, 23 bp, Artificial Sequence
  gRNA target sequence
cccctcccactcccatactacta

SEQ ID NO: 898 - DNA, 23 bp, Artificial Sequence
  gRNA target sequence
ccctcccactcccatactactaa

SEQ ID NO: 899 - DNA, 23 bp, Artificial Sequence
  gRNA target sequence
cctcccactcccatactactaat

SEQ ID NO: 900 - DNA, 23 bp, Artificial Sequence
  gRNA target sequence
cccactcccatactactaatctc

SEQ ID NO: 901 - DNA, 23 bp, Artificial Sequence
  gRNA target sequence
ccactcccatactactaatctca

SEQ ID NO: 902 - DNA, 23 bp, Artificial Sequence
  gRNA target sequence
cccatactactaatctcatcaat

SEQ ID NO: 903 - DNA, 23 bp, Artificial Sequence
  gRNA target sequence
ccatactactaatctcatcaata

SEQ ID NO: 904 - DNA, 23 bp, Artificial Sequence
  gRNA target sequence
cccccgcccatcctacccagcac

SEQ ID NO: 905 - DNA, 23 bp, Artificial Sequence
  gRNA target sequence
ccccgcccatcctacccagcaca

SEQ ID NO: 906 - DNA, 23 bp, Artificial Sequence
  gRNA target sequence
cccgcccatcctacccagcacac

SEQ ID NO: 907 - DNA, 23 bp, Artificial Sequence
  gRNA target sequence
ccgcccatcctacccagcacaca

SEQ ID NO: 908 - DNA, 23 bp, Artificial Sequence
  gRNA target sequence
cccatcctacccagcacacacac

SEQ ID NO: 909 - DNA, 23 bp, Artificial Sequence
  gRNA target sequence
ccatcctacccagcacacacaca

SEQ ID NO: 910 - DNA, 23 bp, Artificial Sequence
  gRNA target sequence
cctacccagcacacacacaccgc

SEQ ID NO: 911 - DNA, 23 bp, Artificial Sequence
  gRNA target sequence
cccagcacacacacaccgctgct

SEQ ID NO: 912 - DNA, 23 bp, Artificial Sequence
  gRNA target sequence
ccagcacacacacaccgctgcta

SEQ ID NO: 913 - DNA, 23 bp, Artificial Sequence
  gRNA target sequence
ccgctgctaaccccataccccga

SEQ ID NO: 914 - DNA, 23 bp, Artificial Sequence
  gRNA target sequence
ccccataccccgaaccaaccaaa

SEQ ID NO: 915 - DNA, 23 bp, Artificial Sequence
  gRNA target sequence
cccataccccgaaccaaccaaac

SEQ ID NO: 916 - DNA, 23 bp, Artificial Sequence
  gRNA target sequence
ccataccccgaaccaaccaaacc

SEQ ID NO: 917 - DNA, 23 bp, Artificial Sequence
  gRNA target sequence
ccccgaaccaaccaaaccccaaa

SEQ ID NO: 918 - DNA, 23 bp, Artificial Sequence
  gRNA target sequence
cccgaaccaaccaaaccccaaag

SEQ ID NO: 919 - DNA, 23 bp, Artificial Sequence
  gRNA target sequence
ccgaaccaaccaaaccccaaaga

SEQ ID NO: 920 - DNA, 23 bp, Artificial Sequence
  gRNA target sequence
ccaaccaaaccccaaagacaccc

SEQ ID NO: 921 - DNA, 23 bp, Artificial Sequence
  gRNA target sequence
ccaaaccccaaagacacccccca

SEQ ID NO: 922 - DNA, 23 bp, Artificial Sequence
  gRNA target sequence
ccccaaagacaccccccacagtt

SEQ ID NO: 923 - DNA, 23 bp, Artificial Sequence
  gRNA target sequence
cccaaagacaccccccacagttt

SEQ ID NO: 924 - DNA, 23 bp, Artificial Sequence
  gRNA target sequence
ccaaagacaccccccacagttta

SEQ ID NO: 925 - DNA, 23 bp, Artificial Sequence
  gRNA target sequence
ccccccacagtttatgtagctta

SEQ ID NO: 926 - DNA, 23 bp, Artificial Sequence
  gRNA target sequence
cccccacagtttatgtagcttac

SEQ ID NO: 927 - DNA, 23 bp, Artificial Sequence
  gRNA target sequence
ccccacagtttatgtagcttacc

SEQ ID NO: 928 - DNA, 23 bp, Artificial Sequence
  gRNA target sequence
cccacagtttatgtagcttacct

SEQ ID NO: 929 - DNA, 23 bp, Artificial Sequence
  gRNA target sequence
ccacagtttatgtagcttacctc

SEQ ID NO: 930 - DNA, 23 bp, Artificial Sequence
  gRNA target sequence
cctcctcaaagcaatacactgaa

SEQ ID NO: 931 - DNA, 23 bp, Artificial Sequence
  gRNA target sequence
cctcaaagcaatacactgaaaat

SEQ ID NO: 932 - DNA, 23 bp, Artificial Sequence
  gRNA target sequence
ccccataaacaaataggtttggt

SEQ ID NO: 933 - DNA, 23 bp, Artificial Sequence
  gRNA target sequence
cccataaacaaataggtttggtc

SEQ ID NO: 934 - DNA, 23 bp, Artificial Sequence
  gRNA target sequence
ccataaacaaataggtttggtcc

SEQ ID NO: 935 - DNA, 23 bp, Artificial Sequence
  gRNA target sequence
cctagcctttctattagctctta

SEQ ID NO: 936 - DNA, 23 bp, Artificial Sequence
  gRNA target sequence
cctttctattagctcttagtaag

SEQ ID NO: 937 - DNA, 23 bp, Artificial Sequence
  gRNA target sequence
ccccgttccagtgagttcaccct

SEQ ID NO: 938 - DNA, 23 bp, Artificial Sequence
  gRNA target sequence
cccgttccagtgagttcaccctc

SEQ ID NO: 939 - DNA, 23 bp, Artificial Sequence
  gRNA target sequence
ccgttccagtgagttcaccctct

SEQ ID NO: 940 - DNA, 23 bp, Artificial Sequence
  gRNA target sequence
ccagtgagttcaccctctaaatc

SEQ ID NO: 941 - DNA, 23 bp, Artificial Sequence
  gRNA target sequence
ccctctaaatcaccacgatcaaa

SEQ ID NO: 942 - DNA, 23 bp, Artificial Sequence
  gRNA target sequence
cctctaaatcaccacgatcaaaa

SEQ ID NO: 943 - DNA, 23 bp, Artificial Sequence
  gRNA target sequence
ccacgatcaaaaggaacaagcat

SEQ ID NO: 944 - DNA, 23 bp, Artificial Sequence
  gRNA target sequence
cctagccacacccccacgggaaa

SEQ ID NO: 945 - DNA, 23 bp, Artificial Sequence
  gRNA target sequence
ccacacccccacgggaaacagca

SEQ ID NO: 946 - DNA, 23 bp, Artificial Sequence
  gRNA target sequence
cccccacgggaaacagcagtgat

SEQ ID NO: 947 - DNA, 23 bp, Artificial Sequence
  gRNA target sequence
ccccacgggaaacagcagtgatt

SEQ ID NO: 948 - DNA, 23 bp, Artificial Sequence
  gRNA target sequence
cccacgggaaacagcagtgatta

SEQ ID NO: 949 - DNA, 23 bp, Artificial Sequence
  gRNA target sequence
ccacgggaaacagcagtgattaa

SEQ ID NO: 950 - DNA, 23 bp, Artificial Sequence
  gRNA target sequence
cctttagcaataaacgaaagttt

SEQ ID NO: 951 - DNA, 23 bp, Artificial Sequence
  gRNA target sequence
ccccagggttggtcaatttcgtg

SEQ ID NO: 952 - DNA, 23 bp, Artificial Sequence
  gRNA target sequence
cccagggttggtcaatttcgtgc

SEQ ID NO: 953 - DNA, 23 bp, Artificial Sequence
  gRNA target sequence
ccagggttggtcaatttcgtgcc

SEQ ID NO: 954 - DNA, 23 bp, Artificial Sequence
  gRNA target sequence
ccagccaccgcggtcacacgatt

SEQ ID NO: 955 - DNA, 23 bp, Artificial Sequence
  gRNA target sequence
ccaccgcggtcacacgattaacc

SEQ ID NO: 956 - DNA, 23 bp, Artificial Sequence
  gRNA target sequence
ccgcggtcacacgattaacccaa

SEQ ID NO: 957 - DNA, 23 bp, Artificial Sequence
  gRNA target sequence
cccaagtcaatagaagccggcgt

SEQ ID NO: 958 - DNA, 23 bp, Artificial Sequence
  gRNA target sequence
ccaagtcaatagaagccggcgta

SEQ ID NO: 959 - DNA, 23 bp, Artificial Sequence
  gRNA target sequence
ccggcgtaaagagtgttttagat

SEQ ID NO: 960 - DNA, 23 bp, Artificial Sequence
  gRNA target sequence
ccccctccccaataaagctaaaa

SEQ ID NO: 961 - DNA, 23 bp, Artificial Sequence
  gRNA target sequence
cccctccccaataaagctaaaac

SEQ ID NO: 962 - DNA, 23 bp, Artificial Sequence
  gRNA target sequence
ccctccccaataaagctaaaact

SEQ ID NO: 963 - DNA, 23 bp, Artificial Sequence
  gRNA target sequence
cctccccaataaagctaaaactc

SEQ ID NO: 964 - DNA, 23 bp, Artificial Sequence
  gRNA target sequence
ccccaataaagctaaaactcacc

SEQ ID NO: 965 - DNA, 23 bp, Artificial Sequence
  gRNA target sequence
cccaataaagctaaaactcacct

SEQ ID NO: 966 - DNA, 23 bp, Artificial Sequence
  gRNA target sequence
ccaataaagctaaaactcacctg

SEQ ID NO: 967 - DNA, 23 bp, Artificial Sequence
  gRNA target sequence
cctgagttgtaaaaaactccagt

SEQ ID NO: 968 - DNA, 23 bp, Artificial Sequence
  gRNA target sequence
ccagttgacacaaaatagactac

SEQ ID NO: 969 - DNA, 23 bp, Artificial Sequence
  gRNA target sequence
cccaaactgggattagatacccc

SEQ ID NO: 970 - DNA, 23 bp, Artificial Sequence
  gRNA target sequence
ccaaactgggattagatacccca

SEQ ID NO: 971 - DNA, 23 bp, Artificial Sequence
  gRNA target sequence
ccccactatgcttagccctaaac

SEQ ID NO: 972 - DNA, 23 bp, Artificial Sequence
  gRNA target sequence
cccactatgcttagccctaaacc

SEQ ID NO: 973 - DNA, 23 bp, Artificial Sequence
  gRNA target sequence
ccactatgcttagccctaaacct

SEQ ID NO: 974 - DNA, 23 bp, Artificial Sequence
  gRNA target sequence
ccctaaacctcaacagttaaatc

SEQ ID NO: 975 - DNA, 23 bp, Artificial Sequence
  gRNA target sequence
cctaaacctcaacagttaaatca

SEQ ID NO: 976 - DNA, 23 bp, Artificial Sequence
  gRNA target sequence
cctcaacagttaaatcaacaaaa

SEQ ID NO: 977 - DNA, 23 bp, Artificial Sequence
  gRNA target sequence
ccagaacactacgagccacagct

SEQ ID NO: 978 - DNA, 23 bp, Artificial Sequence
  gRNA target sequence
ccacagcttaaaactcaaaggac

SEQ ID NO: 979 - DNA, 23 bp, Artificial Sequence
  gRNA target sequence
cctggcggtgcttcatatccctc

SEQ ID NO: 980 - DNA, 23 bp, Artificial Sequence
  gRNA target sequence
ccctctagaggagcctgttctgt

SEQ ID NO: 981 - DNA, 23 bp, Artificial Sequence
  gRNA target sequence
cctctagaggagcctgttctgta

SEQ ID NO: 982 - DNA, 23 bp, Artificial Sequence
  gRNA target sequence
cctgttctgtaatcgataaaccc

SEQ ID NO: 983 - DNA, 23 bp, Artificial Sequence
  gRNA target sequence
ccccgatcaacctcaccacctct

SEQ ID NO: 984 - DNA, 23 bp, Artificial Sequence
  gRNA target sequence
cccgatcaacctcaccacctctt

SEQ ID NO: 985 - DNA, 23 bp, Artificial Sequence
  gRNA target sequence
ccgatcaacctcaccacctcttg

SEQ ID NO: 986 - DNA, 23 bp, Artificial Sequence
  gRNA target sequence
cctcaccacctcttgctcagcct

SEQ ID NO: 987 - DNA, 23 bp, Artificial Sequence
  gRNA target sequence
ccacctcttgctcagcctatata

SEQ ID NO: 988 - DNA, 23 bp, Artificial Sequence
  gRNA target sequence
cctcttgctcagcctatataccg

SEQ ID NO: 989 - DNA, 23 bp, Artificial Sequence
  gRNA target sequence
cctatataccgccatcttcagca

SEQ ID NO: 990 - DNA, 23 bp, Artificial Sequence
  gRNA target sequence
ccgccatcttcagcaaaccctga

SEQ ID NO: 991 - DNA, 23 bp, Artificial Sequence
  gRNA target sequence
ccatcttcagcaaaccctgatga

SEQ ID NO: 992 - DNA, 23 bp, Artificial Sequence
  gRNA target sequence
ccctgatgaaggctacaaagtaa

SEQ ID NO: 993 - DNA, 23 bp, Artificial Sequence
  gRNA target sequence
cctgatgaaggctacaaagtaag

SEQ ID NO: 994 - DNA, 23 bp, Artificial Sequence
  gRNA target sequence
cccacgtaaagacgttaggtcaa

SEQ ID NO: 995 - DNA, 23 bp, Artificial Sequence
  gRNA target sequence
ccacgtaaagacgttaggtcaag

SEQ ID NO: 996 - DNA, 23 bp, Artificial Sequence
  gRNA target sequence
cccatgaggtggcaagaaatggg

SEQ ID NO: 997 - DNA, 23 bp, Artificial Sequence
  gRNA target sequence
ccatgaggtggcaagaaatgggc

SEQ ID NO: 998 - DNA, 23 bp, Artificial Sequence
  gRNA target sequence
ccccagaaaactacgatagccct

SEQ ID NO: 999 - DNA, 23 bp, Artificial Sequence
  gRNA target sequence
cccagaaaactacgatagccctt

SEQ ID NO: 1000 - DNA, 23 bp, Artificial Sequence
  gRNA target sequence
ccagaaaactacgatagccctta

SEQ ID NO: 1001 - DNA, 23 bp, Artificial Sequence
  gRNA target sequence
cccttatgaaacttaagggtcga

SEQ ID NO: 1002 - DNA, 23 bp, Artificial Sequence
  gRNA target sequence
ccttatgaaacttaagggtcgaa

SEQ ID NO: 1003 - DNA, 23 bp, Artificial Sequence
  gRNA target sequence
ccctgaagcgcgtacacaccgcc

SEQ ID NO: 1004 - DNA, 23 bp, Artificial Sequence
  gRNA target sequence
cctgaagcgcgtacacaccgccc

SEQ ID NO: 1005 - DNA, 23 bp, Artificial Sequence
  gRNA target sequence
ccgcccgtcaccctcctcaagta

SEQ ID NO: 1006 - DNA, 23 bp, Artificial Sequence
  gRNA target sequence
cccgtcaccctcctcaagtatac

SEQ ID NO: 1007 - DNA, 23 bp, Artificial Sequence
  gRNA target sequence
ccgtcaccctcctcaagtatact

SEQ ID NO: 1008 - DNA, 23 bp, Artificial Sequence
  gRNA target sequence
ccctcctcaagtatacttcaaag

SEQ ID NO: 1009 - DNA, 23 bp, Artificial Sequence
  gRNA target sequence
cctcctcaagtatacttcaaagg

SEQ ID NO: 1010 - DNA, 23 bp, Artificial Sequence
  gRNA target sequence
cctcaagtatacttcaaaggaca

SEQ ID NO: 1011 - DNA, 23 bp, Artificial Sequence
  gRNA target sequence
cccctacgcatttatatagagga

SEQ ID NO: 1012 - DNA, 23 bp, Artificial Sequence
  gRNA target sequence
ccctacgcatttatatagaggag

SEQ ID NO: 1013 - DNA, 23 bp, Artificial Sequence
  gRNA target sequence
cctacgcatttatatagaggaga

SEQ ID NO: 1014 - DNA, 23 bp, Artificial Sequence
  gRNA target sequence
ccagagtgtagcttaacacaaag

SEQ ID NO: 1015 - DNA, 23 bp, Artificial Sequence
  gRNA target sequence
cccaacttacacttaggagattt

SEQ ID NO: 1016 - DNA, 23 bp, Artificial Sequence
  gRNA target sequence
ccaacttacacttaggagatttc

SEQ ID NO: 1017 - DNA, 23 bp, Artificial Sequence
  gRNA target sequence
ccgctctgagctaaacctagccc

SEQ ID NO: 1018 - DNA, 23 bp, Artificial Sequence
  gRNA target sequence
cctagccccaaacccactccacc

SEQ ID NO: 1019 - DNA, 23 bp, Artificial Sequence
  gRNA target sequence
ccccaaacccactccaccttact

SEQ ID NO: 1020 - DNA, 23 bp, Artificial Sequence
  gRNA target sequence
cccaaacccactccaccttacta

SEQ ID NO: 1021 - DNA, 23 bp, Artificial Sequence
  gRNA target sequence
ccaaacccactccaccttactac

SEQ ID NO: 1022 - DNA, 23 bp, Artificial Sequence
  gRNA target sequence
cccactccaccttactaccagac

SEQ ID NO: 1023 - DNA, 23 bp, Artificial Sequence
  gRNA target sequence
ccactccaccttactaccagaca

SEQ ID NO: 1024 - DNA, 23 bp, Artificial Sequence
  gRNA target sequence
ccaccttactaccagacaacctt

SEQ ID NO: 1025 - DNA, 23 bp, Artificial Sequence
  gRNA target sequence
ccttactaccagacaaccttagc

SEQ ID NO: 1026 - DNA, 23 bp, Artificial Sequence
  gRNA target sequence
ccagacaaccttagccaaaccat

SEQ ID NO: 1027 - DNA, 23 bp, Artificial Sequence
  gRNA target sequence
ccttagccaaaccatttacccaa

SEQ ID NO: 1028 - DNA, 23 bp, Artificial Sequence
  gRNA target sequence
ccaaaccatttacccaaataaag

SEQ ID NO: 1029 - DNA, 23 bp, Artificial Sequence
  gRNA target sequence
ccatttacccaaataaagtatag

SEQ ID NO: 1030 - DNA, 23 bp, Artificial Sequence
  gRNA target sequence
cccaaataaagtataggcgatag

SEQ ID NO: 1031 - DNA, 23 bp, Artificial Sequence
  gRNA target sequence
ccaaataaagtataggcgataga

SEQ ID NO: 1032 - DNA, 23 bp, Artificial Sequence
  gRNA target sequence
cctggcgcaatagatatagtacc

SEQ ID NO: 1033 - DNA, 23 bp, Artificial Sequence
  gRNA target sequence
ccgcaagggaaagatgaaaaatt

SEQ ID NO: 1034 - DNA, 23 bp, Artificial Sequence
  gRNA target sequence
ccaagcataatatagcaaggact

SEQ ID NO: 1035 - DNA, 23 bp, Artificial Sequence
  gRNA target sequence
cccctataccttctgcataatga

SEQ ID NO: 1036 - DNA, 23 bp, Artificial Sequence
  gRNA target sequence
ccctataccttctgcataatgaa

SEQ ID NO: 1037 - DNA, 23 bp, Artificial Sequence
  gRNA target sequence
cctataccttctgcataatgaat

SEQ ID NO: 1038 - DNA, 23 bp, Artificial Sequence
  gRNA target sequence
ccttctgcataatgaattaacta

SEQ ID NO: 1039 - DNA, 23 bp, Artificial Sequence
  gRNA target sequence
ccaaagctaagacccccgaaacc

SEQ ID NO: 1040 - DNA, 23 bp, Artificial Sequence
  gRNA target sequence
cccccgaaaccagacgagctacc

SEQ ID NO: 1041 - DNA, 23 bp, Artificial Sequence
  gRNA target sequence
ccccgaaaccagacgagctacct

SEQ ID NO: 1042 - DNA, 23 bp, Artificial Sequence
  gRNA target sequence
cccgaaaccagacgagctaccta

SEQ ID NO: 1043 - DNA, 23 bp, Artificial Sequence
  gRNA target sequence
ccgaaaccagacgagctacctaa

SEQ ID NO: 1044 - DNA, 23 bp, Artificial Sequence
  gRNA target sequence
ccagacgagctacctaagaacag

SEQ ID NO: 1045 - DNA, 23 bp, Artificial Sequence
  gRNA target sequence
cctaagaacagctaaaagagcac

SEQ ID NO: 1046 - DNA, 23 bp, Artificial Sequence
  gRNA target sequence
cccgtctatgtagcaaaatagtg

SEQ ID NO: 1047 - DNA, 23 bp, Artificial Sequence
  gRNA target sequence
ccgtctatgtagcaaaatagtgg

SEQ ID NO: 1048 - DNA, 23 bp, Artificial Sequence
  gRNA target sequence
cctaccgagcctggtgatagctg

SEQ ID NO: 1049 - DNA, 23 bp, Artificial Sequence
  gRNA target sequence
ccgagcctggtgatagctggttg

SEQ ID NO: 1050 - DNA, 23 bp, Artificial Sequence
  gRNA target sequence
cctggtgatagctggttgtccaa

SEQ ID NO: 1051 - DNA, 23 bp, Artificial Sequence
  gRNA target sequence
ccaagatagaatcttagttcaac

SEQ ID NO: 1052 - DNA, 23 bp, Artificial Sequence
  gRNA target sequence
cccacagaaccctctaaatcccc

SEQ ID NO: 1053 - DNA, 23 bp, Artificial Sequence
  gRNA target sequence
ccacagaaccctctaaatcccct

SEQ ID NO: 1054 - DNA, 23 bp, Artificial Sequence
  gRNA target sequence
ccctctaaatccccttgtaaatt

SEQ ID NO: 1055 - DNA, 23 bp, Artificial Sequence
  gRNA target sequence
cctctaaatccccttgtaaattt

SEQ ID NO: 1056 - DNA, 23 bp, Artificial Sequence
  gRNA target sequence
ccccttgtaaatttaactgttag

SEQ ID NO: 1057 - DNA, 23 bp, Artificial Sequence
  gRNA target sequence
cccttgtaaatttaactgttagt

SEQ ID NO: 1058 - DNA, 23 bp, Artificial Sequence
  gRNA target sequence
ccttgtaaatttaactgttagtc

SEQ ID NO: 1059 - DNA, 23 bp, Artificial Sequence
  gRNA target sequence
ccaaagaggaacagctctttgga

SEQ ID NO: 1060 - DNA, 23 bp, Artificial Sequence
  gRNA target sequence
ccttgtagagagagtaaaaaatt

SEQ ID NO: 1061 - DNA, 23 bp, Artificial Sequence
  gRNA target sequence
cccatagtaggcctaaaagcagc

SEQ ID NO: 1062 - DNA, 23 bp, Artificial Sequence
  gRNA target sequence
ccatagtaggcctaaaagcagcc

SEQ ID NO: 1063 - DNA, 23 bp, Artificial Sequence
  gRNA target sequence
cctaaaagcagccaccaattaag

SEQ ID NO: 1064 - DNA, 23 bp, Artificial Sequence
  gRNA target sequence
ccaccaattaagaaagcgttcaa

SEQ ID NO: 1065 - DNA, 23 bp, Artificial Sequence
  gRNA target sequence
ccaattaagaaagcgttcaagct

SEQ ID NO: 1066 - DNA, 23 bp, Artificial Sequence
  gRNA target sequence
cccactacctaaaaaatcccaaa

SEQ ID NO: 1067 - DNA, 23 bp, Artificial Sequence
  gRNA target sequence
ccactacctaaaaaatcccaaac

SEQ ID NO: 1068 - DNA, 23 bp, Artificial Sequence
  gRNA target sequence
cctaaaaaatcccaaacatataa

SEQ ID NO: 1069 - DNA, 23 bp, Artificial Sequence
  gRNA target sequence
cccaaacatataactgaactcct

SEQ ID NO: 1070 - DNA, 23 bp, Artificial Sequence
  gRNA target sequence
ccaaacatataactgaactcctc

SEQ ID NO: 1071 - DNA, 23 bp, Artificial Sequence
  gRNA target sequence
cctcacacccaattggaccaatc

SEQ ID NO: 1072 - DNA, 23 bp, Artificial Sequence
  gRNA target sequence
cccaattggaccaatctatcacc

SEQ ID NO: 1073 - DNA, 23 bp, Artificial Sequence
  gRNA target sequence
ccaattggaccaatctatcaccc

SEQ ID NO: 1074 - DNA, 23 bp, Artificial Sequence
  gRNA target sequence
ccaatctatcaccctatagaaga

SEQ ID NO: 1075 - DNA, 23 bp, Artificial Sequence
  gRNA target sequence
ccctatagaagaactaatgttag

SEQ ID NO: 1076 - DNA, 23 bp, Artificial Sequence
  gRNA target sequence
cctatagaagaactaatgttagt

SEQ ID NO: 1077 - DNA, 23 bp, Artificial Sequence
  gRNA target sequence
cctccgcataagcctgcgtcaga

SEQ ID NO: 1078 - DNA, 23 bp, Artificial Sequence
  gRNA target sequence
ccgcataagcctgcgtcagatta

SEQ ID NO: 1079 - DNA, 23 bp, Artificial Sequence
  gRNA target sequence
cctgcgtcagattaaaacactga

SEQ ID NO: 1080 - DNA, 23 bp, Artificial Sequence
  gRNA target sequence
cccaatatctacaatcaaccaac

SEQ ID NO: 1081 - DNA, 23 bp, Artificial Sequence
  gRNA target sequence
ccaatatctacaatcaaccaaca

SEQ ID NO: 1082 - DNA, 23 bp, Artificial Sequence
  gRNA target sequence
ccaacaagtcattattaccctca

SEQ ID NO: 1083 - DNA, 23 bp, Artificial Sequence
  gRNA target sequence
ccctcactgtcaacccaacacag

SEQ ID NO: 1084 - DNA, 23 bp, Artificial Sequence
  gRNA target sequence
cctcactgtcaacccaacacagg

SEQ ID NO: 1085 - DNA, 23 bp, Artificial Sequence
  gRNA target sequence
cccaacacaggcatgctcataag

SEQ ID NO: 1086 - DNA, 23 bp, Artificial Sequence
  gRNA target sequence
ccaacacaggcatgctcataagg

SEQ ID NO: 1087 - DNA, 23 bp, Artificial Sequence
  gRNA target sequence
ccccgcctgtttaccaaaaacat

SEQ ID NO: 1088 - DNA, 23 bp, Artificial Sequence
  gRNA target sequence
cccgcctgtttaccaaaaacatc

SEQ ID NO: 1089 - DNA, 23 bp, Artificial Sequence
  gRNA target sequence
ccgcctgtttaccaaaaacatca

SEQ ID NO: 1090 - DNA, 23 bp, Artificial Sequence
  gRNA target sequence
cctgtttaccaaaaacatcacct

SEQ ID NO: 1091 - DNA, 23 bp, Artificial Sequence
  gRNA target sequence
ccaaaaacatcacctctagcatc

SEQ ID NO: 1092 - DNA, 23 bp, Artificial Sequence
  gRNA target sequence
cctctagcatcaccagtattaga

SEQ ID NO: 1093 - DNA, 23 bp, Artificial Sequence
  gRNA target sequence
ccagtattagaggcaccgcctgc

SEQ ID NO: 1094 - DNA, 23 bp, Artificial Sequence
  gRNA target sequence
ccgcctgcccagtgacacatgtt

SEQ ID NO: 1095 - DNA, 23 bp, Artificial Sequence
  gRNA target sequence
cctgcccagtgacacatgtttaa

SEQ ID NO: 1096 - DNA, 23 bp, Artificial Sequence
  gRNA target sequence
cccagtgacacatgtttaacggc

SEQ ID NO: 1097 - DNA, 23 bp, Artificial Sequence
  gRNA target sequence
ccagtgacacatgtttaacggcc

SEQ ID NO: 1098 - DNA, 23 bp, Artificial Sequence
  gRNA target sequence
ccgcggtaccctaaccgtgcaaa

SEQ ID NO: 1099 - DNA, 23 bp, Artificial Sequence
  gRNA target sequence
ccctaaccgtgcaaaggtagcat

SEQ ID NO: 1100 - DNA, 23 bp, Artificial Sequence
  gRNA target sequence
cctaaccgtgcaaaggtagcata

SEQ ID NO: 1101 - DNA, 23 bp, Artificial Sequence
  gRNA target sequence
ccgtgcaaaggtagcataatcac

SEQ ID NO: 1102 - DNA, 23 bp, Artificial Sequence
  gRNA target sequence
ccttaaatagggacctgtatgaa

SEQ ID NO: 1103 - DNA, 23 bp, Artificial Sequence
  gRNA target sequence
cctgtatgaatggctccacgagg

SEQ ID NO: 1104 - DNA, 23 bp, Artificial Sequence
  gRNA target sequence
ccacgagggttcagctgtctctt

SEQ ID NO: 1105 - DNA, 23 bp, Artificial Sequence
  gRNA target sequence
ccagtgaaattgacctgcccgtg

SEQ ID NO: 1106 - DNA, 23 bp, Artificial Sequence
  gRNA target sequence
cctgcccgtgaagaggcgggcat

SEQ ID NO: 1107 - DNA, 23 bp, Artificial Sequence
  gRNA target sequence
cccgtgaagaggcgggcataaca

SEQ ID NO: 1108 - DNA, 23 bp, Artificial Sequence
  gRNA target sequence
ccgtgaagaggcgggcataacac

SEQ ID NO: 1109 - DNA, 23 bp, Artificial Sequence
  gRNA target sequence
ccctatggagctttaatttatta

SEQ ID NO: 1110 - DNA, 23 bp, Artificial Sequence
  gRNA target sequence
cctatggagctttaatttattaa

SEQ ID NO: 1111 - DNA, 23 bp, Artificial Sequence
  gRNA target sequence
cctaacaaacccacaggtcctaa

SEQ ID NO: 1112 - DNA, 23 bp, Artificial Sequence
  gRNA target sequence
cccacaggtcctaaactaccaaa

SEQ ID NO: 1113 - DNA, 23 bp, Artificial Sequence
  gRNA target sequence
ccacaggtcctaaactaccaaac

SEQ ID NO: 1114 - DNA, 23 bp, Artificial Sequence
  gRNA target sequence
cctaaactaccaaacctgcatta

SEQ ID NO: 1115 - DNA, 23 bp, Artificial Sequence
  gRNA target sequence
ccaaacctgcattaaaaatttcg

SEQ ID NO: 1116 - DNA, 23 bp, Artificial Sequence
  gRNA target sequence
cctgcattaaaaatttcggttgg

SEQ ID NO: 1117 - DNA, 23 bp, Artificial Sequence
  gRNA target sequence
cctcggagcagaacccaacctcc

SEQ ID NO: 1118 - DNA, 23 bp, Artificial Sequence
  gRNA target sequence
cccaacctccgagcagtacatgc

SEQ ID NO: 1119 - DNA, 23 bp, Artificial Sequence
  gRNA target sequence
ccaacctccgagcagtacatgct

SEQ ID NO: 1120 - DNA, 23 bp, Artificial Sequence
  gRNA target sequence
cctccgagcagtacatgctaaga

SEQ ID NO: 1121 - DNA, 23 bp, Artificial Sequence
  gRNA target sequence
ccgagcagtacatgctaagactt

SEQ ID NO: 1122 - DNA, 23 bp, Artificial Sequence
  gRNA target sequence
ccagtcaaagcgaactactatac

SEQ ID NO: 1123 - DNA, 23 bp, Artificial Sequence
  gRNA target sequence
ccaataacttgaccaacggaaca

SEQ ID NO: 1124 - DNA, 23 bp, Artificial Sequence
  gRNA target sequence
ccaacggaacaagttaccctagg

SEQ ID NO: 1125 - DNA, 23 bp, Artificial Sequence
  gRNA target sequence
ccctagggataacagcgcaatcc

SEQ ID NO: 1126 - DNA, 23 bp, Artificial Sequence
  gRNA target sequence
cctagggataacagcgcaatcct

SEQ ID NO: 1127 - DNA, 23 bp, Artificial Sequence
  gRNA target sequence
cctattctagagtccatatcaac

SEQ ID NO: 1128 - DNA, 23 bp, Artificial Sequence
  gRNA target sequence
ccatatcaacaatagggtttacg

SEQ ID NO: 1129 - DNA, 23 bp, Artificial Sequence
  gRNA target sequence
cctcgatgttggatcaggacatc

SEQ ID NO: 1130 - DNA, 23 bp, Artificial Sequence
  gRNA target sequence
cccgatggtgcagccgctattaa

SEQ ID NO: 1131 - DNA, 23 bp, Artificial Sequence
  gRNA target sequence
ccgatggtgcagccgctattaaa

SEQ ID NO: 1132 - DNA, 23 bp, Artificial Sequence
  gRNA target sequence
ccgctattaaaggttcgtttgtt

SEQ ID NO: 1133 - DNA, 23 bp, Artificial Sequence
  gRNA target sequence
cctacgtgatctgagttcagacc

SEQ ID NO: 1134 - DNA, 23 bp, Artificial Sequence
  gRNA target sequence
ccggagtaatccaggtcggtttc

SEQ ID NO: 1135 - DNA, 23 bp, Artificial Sequence
  gRNA target sequence
  variation (21)...(21): n = A, T, C, or G
ccaggtcggtttctatctacntt

SEQ ID NO: 1136 - DNA, 23 bp, Artificial Sequence
  gRNA target sequence
cctccctgtacgaaaggacaaga

SEQ ID NO: 1137 - DNA, 23 bp, Artificial Sequence
  gRNA target sequence
ccctgtacgaaaggacaagagaa

SEQ ID NO: 1138 - DNA, 23 bp, Artificial Sequence
  gRNA target sequence
cctgtacgaaaggacaagagaaa

SEQ ID NO: 1139 - DNA, 23 bp, Artificial Sequence
  gRNA target sequence
cctacttcacaaagcgccttccc

SEQ ID NO: 1140 - DNA, 23 bp, Artificial Sequence
  gRNA target sequence
ccttcccccgtaaatgatatcat

SEQ ID NO: 1141 - DNA, 23 bp, Artificial Sequence
  gRNA target sequence
cccccgtaaatgatatcatctca

SEQ ID NO: 1142 - DNA, 23 bp, Artificial Sequence
  gRNA target sequence
ccccgtaaatgatatcatctcaa

SEQ ID NO: 1143 - DNA, 23 bp, Artificial Sequence
  gRNA target sequence
cccgtaaatgatatcatctcaac

SEQ ID NO: 1144 - DNA, 23 bp, Artificial Sequence
  gRNA target sequence
ccgtaaatgatatcatctcaact

SEQ ID NO: 1145 - DNA, 23 bp, Artificial Sequence
  gRNA target sequence
cccacacccacccaagaacaggg

SEQ ID NO: 1146 - DNA, 23 bp, Artificial Sequence
  gRNA target sequence
ccacacccacccaagaacagggt

SEQ ID NO: 1147 - DNA, 23 bp, Artificial Sequence
  gRNA target sequence
cccacccaagaacagggtttgtt

SEQ ID NO: 1148 - DNA, 23 bp, Artificial Sequence
  gRNA target sequence
ccacccaagaacagggtttgtta

SEQ ID NO: 1149 - DNA, 23 bp, Artificial Sequence
  gRNA target sequence
cccaagaacagggtttgttaaga

SEQ ID NO: 1150 - DNA, 23 bp, Artificial Sequence
  gRNA target sequence
ccaagaacagggtttgttaagat

SEQ ID NO: 1151 - DNA, 23 bp, Artificial Sequence
  gRNA target sequence
cccggtaatcgcataaaacttaa

SEQ ID NO: 1152 - DNA, 23 bp, Artificial Sequence
  gRNA target sequence
ccggtaatcgcataaaacttaaa

SEQ ID NO: 1153 - DNA, 23 bp, Artificial Sequence
  gRNA target sequence
cctcttcttaacaacatacccat

SEQ ID NO: 1154 - DNA, 23 bp, Artificial Sequence
  gRNA target sequence
cccatggccaacctcctactcct

SEQ ID NO: 1155 - DNA, 23 bp, Artificial Sequence
  gRNA target sequence
ccatggccaacctcctactcctc

SEQ ID NO: 1156 - DNA, 23 bp, Artificial Sequence
  gRNA target sequence
ccaacctcctactcctcattgta

SEQ ID NO: 1157 - DNA, 23 bp, Artificial Sequence
  gRNA target sequence
cctcctactcctcattgtaccca

SEQ ID NO: 1158 - DNA, 23 bp, Artificial Sequence
  gRNA target sequence
cctactcctcattgtacccattc

SEQ ID NO: 1159 - DNA, 23 bp, Artificial Sequence
  gRNA target sequence
cctcattgtacccattctaatcg

SEQ ID NO: 1160 - DNA, 23 bp, Artificial Sequence
  gRNA target sequence
cccattctaatcgcaatggcatt

SEQ ID NO: 1161 - DNA, 23 bp, Artificial Sequence
  gRNA target sequence
ccattctaatcgcaatggcattc

SEQ ID NO: 1162 - DNA, 23 bp, Artificial Sequence
  gRNA target sequence
cctaatgcttaccgaacgaaaaa

SEQ ID NO: 1163 - DNA, 23 bp, Artificial Sequence
  gRNA target sequence
ccgaacgaaaaattctaggctat

SEQ ID NO: 1164 - DNA, 23 bp, Artificial Sequence
  gRNA target sequence
ccccaacgttgtaggcccctacg

SEQ ID NO: 1165 - DNA, 23 bp, Artificial Sequence
  gRNA target sequence
cccaacgttgtaggcccctacgg

SEQ ID NO: 1166 - DNA, 23 bp, Artificial Sequence
  gRNA target sequence
ccaacgttgtaggcccctacggg

SEQ ID NO: 1167 - DNA, 23 bp, Artificial Sequence
  gRNA target sequence
cccctacgggctactacaaccct

SEQ ID NO: 1168 - DNA, 23 bp, Artificial Sequence
  gRNA target sequence
ccctacgggctactacaaccctt

SEQ ID NO: 1169 - DNA, 23 bp, Artificial Sequence
  gRNA target sequence
cctacgggctactacaacccttc

SEQ ID NO: 1170 - DNA, 23 bp, Artificial Sequence
  gRNA target sequence
cccttcgctgacgccataaaact

SEQ ID NO: 1171 - DNA, 23 bp, Artificial Sequence
  gRNA target sequence
ccttcgctgacgccataaaactc

SEQ ID NO: 1172 - DNA, 23 bp, Artificial Sequence
  gRNA target sequence
ccataaaactcttcaccaaagag

SEQ ID NO: 1173 - DNA, 23 bp, Artificial Sequence
  gRNA target sequence
ccaaagagcccctaaaacccgcc

SEQ ID NO: 1174 - DNA, 23 bp, Artificial Sequence
  gRNA target sequence
cccctaaaacccgccacatctac

SEQ ID NO: 1175 - DNA, 23 bp, Artificial Sequence
  gRNA target sequence
ccctaaaacccgccacatctacc

SEQ ID NO: 1176 - DNA, 23 bp, Artificial Sequence
  gRNA target sequence
cctaaaacccgccacatctacca

SEQ ID NO: 1177 - DNA, 23 bp, Artificial Sequence
  gRNA target sequence
cccgccacatctaccatcaccct

SEQ ID NO: 1178 - DNA, 23 bp, Artificial Sequence
  gRNA target sequence
ccgccacatctaccatcaccctc

SEQ ID NO: 1179 - DNA, 23 bp, Artificial Sequence
  gRNA target sequence
ccacatctaccatcaccctctac

SEQ ID NO: 1180 - DNA, 23 bp, Artificial Sequence
  gRNA target sequence
ccatcaccctctacatcaccgcc

SEQ ID NO: 1181 - DNA, 23 bp, Artificial Sequence
  gRNA target sequence
ccctctacatcaccgccccgacc

SEQ ID NO: 1182 - DNA, 23 bp, Artificial Sequence
  gRNA target sequence
cctctacatcaccgccccgacct

SEQ ID NO: 1183 - DNA, 23 bp, Artificial Sequence
  gRNA target sequence
ccgccccgaccttagctctcacc

SEQ ID NO: 1184 - DNA, 23 bp, Artificial Sequence
  gRNA target sequence
ccccgaccttagctctcaccatc

SEQ ID NO: 1185 - DNA, 23 bp, Artificial Sequence
  gRNA target sequence
cccgaccttagctctcaccatcg

SEQ ID NO: 1186 - DNA, 23 bp, Artificial Sequence
  gRNA target sequence
ccgaccttagctctcaccatcgc

SEQ ID NO: 1187 - DNA, 23 bp, Artificial Sequence
  gRNA target sequence
ccttagctctcaccatcgctctt

SEQ ID NO: 1188 - DNA, 23 bp, Artificial Sequence
  gRNA target sequence
ccatcgctcttctactatgaacc

SEQ ID NO: 1189 - DNA, 23 bp, Artificial Sequence
  gRNA target sequence
cccccctccccatacccaacccc

SEQ ID NO: 1190 - DNA, 23 bp, Artificial Sequence
  gRNA target sequence
ccccctccccatacccaaccccc

SEQ ID NO: 1191 - DNA, 23 bp, Artificial Sequence
  gRNA target sequence
cccctccccatacccaaccccct

SEQ ID NO: 1192 - DNA, 23 bp, Artificial Sequence
  gRNA target sequence
ccctccccatacccaaccccctg

SEQ ID NO: 1193 - DNA, 23 bp, Artificial Sequence
  gRNA target sequence
cctccccatacccaaccccctgg

SEQ ID NO: 1194 - DNA, 23 bp, Artificial Sequence
  gRNA target sequence
ccccatacccaaccccctggtca

SEQ ID NO: 1195 - DNA, 23 bp, Artificial Sequence
  gRNA target sequence
cccatacccaaccccctggtcaa

SEQ ID NO: 1196 - DNA, 23 bp, Artificial Sequence
  gRNA target sequence
ccatacccaaccccctggtcaac

SEQ ID NO: 1197 - DNA, 23 bp, Artificial Sequence
  gRNA target sequence
cccaaccccctggtcaacctcaa

SEQ ID NO: 1198 - DNA, 23 bp, Artificial Sequence
  gRNA target sequence
ccaaccccctggtcaacctcaac

SEQ ID NO: 1199 - DNA, 23 bp, Artificial Sequence
  gRNA target sequence
ccccctggtcaacctcaacctag

SEQ ID NO: 1200 - DNA, 23 bp, Artificial Sequence
  gRNA target sequence
cccctggtcaacctcaacctagg

SEQ ID NO: 1201 - DNA, 23 bp, Artificial Sequence
  gRNA target sequence
ccctggtcaacctcaacctaggc

SEQ ID NO: 1202 - DNA, 23 bp, Artificial Sequence
  gRNA target sequence
cctggtcaacctcaacctaggcc

SEQ ID NO: 1203 - DNA, 23 bp, Artificial Sequence
  gRNA target sequence
cctcaacctaggcctcctattta

SEQ ID NO: 1204 - DNA, 23 bp, Artificial Sequence
  gRNA target sequence
cctaggcctcctatttattctag

SEQ ID NO: 1205 - DNA, 23 bp, Artificial Sequence
  gRNA target sequence
cctcctatttattctagccacct

SEQ ID NO: 1206 - DNA, 23 bp, Artificial Sequence
  gRNA target sequence
cctatttattctagccacctcta

SEQ ID NO: 1207 - DNA, 23 bp, Artificial Sequence
  gRNA target sequence
ccacctctagcctagccgtttac

SEQ ID NO: 1208 - DNA, 23 bp, Artificial Sequence
  gRNA target sequence
cctctagcctagccgtttactca

SEQ ID NO: 1209 - DNA, 23 bp, Artificial Sequence
  gRNA target sequence
cctagccgtttactcaatcctct

SEQ ID NO: 1210 - DNA, 23 bp, Artificial Sequence
  gRNA target sequence
ccgtttactcaatcctctgatca

SEQ ID NO: 1211 - DNA, 23 bp, Artificial Sequence
  gRNA target sequence
cctctgatcagggtgagcatcaa

SEQ ID NO: 1212 - DNA, 23 bp, Artificial Sequence
  gRNA target sequence
ccctgatcggcgcactgcgagca

SEQ ID NO: 1213 - DNA, 23 bp, Artificial Sequence
  gRNA target sequence
cctgatcggcgcactgcgagcag

SEQ ID NO: 1214 - DNA, 23 bp, Artificial Sequence
  gRNA target sequence
cccaaacaatctcatatgaagtc

SEQ ID NO: 1215 - DNA, 23 bp, Artificial Sequence
  gRNA target sequence
ccaaacaatctcatatgaagtca

SEQ ID NO: 1216 - DNA, 23 bp, Artificial Sequence
  gRNA target sequence
ccctagccatcattctactatca

SEQ ID NO: 1217 - DNA, 23 bp, Artificial Sequence
  gRNA target sequence
cctagccatcattctactatcaa

SEQ ID NO: 1218 - DNA, 23 bp, Artificial Sequence
  gRNA target sequence
ccatcattctactatcaacatta

SEQ ID NO: 1219 - DNA, 23 bp, Artificial Sequence
  gRNA target sequence
cctttaacctctccacccttatc

SEQ ID NO: 1220 - DNA, 23 bp, Artificial Sequence
  gRNA target sequence
cctctccacccttatcacaacac

SEQ ID NO: 1221 - DNA, 23 bp, Artificial Sequence
  gRNA target sequence
ccacccttatcacaacacaagaa

SEQ ID NO: 1222 - DNA, 23 bp, Artificial Sequence
  gRNA target sequence
cccttatcacaacacaagaacac

SEQ ID NO: 1223 - DNA, 23 bp, Artificial Sequence
  gRNA target sequence
ccttatcacaacacaagaacacc

SEQ ID NO: 1224 - DNA, 23 bp, Artificial Sequence
  gRNA target sequence
cctctgattactcctgccatcat

SEQ ID NO: 1225 - DNA, 23 bp, Artificial Sequence
  gRNA target sequence
cctgccatcatgacccttggcca

SEQ ID NO: 1226 - DNA, 23 bp, Artificial Sequence
  gRNA target sequence
ccatcatgacccttggccataat

SEQ ID NO: 1227 - DNA, 23 bp, Artificial Sequence
  gRNA target sequence
cccttggccataatatgatttat

SEQ ID NO: 1228 - DNA, 23 bp, Artificial Sequence
  gRNA target sequence
ccttggccataatatgatttatc

SEQ ID NO: 1229 - DNA, 23 bp, Artificial Sequence
  gRNA target sequence
ccataatatgatttatctccaca

SEQ ID NO: 1230 - DNA, 23 bp, Artificial Sequence
  gRNA target sequence
ccacactagcagagaccaaccga

SEQ ID NO: 1231 - DNA, 23 bp, Artificial Sequence
  gRNA target sequence
ccaaccgaacccccttcgacctt

SEQ ID NO: 1232 - DNA, 23 bp, Artificial Sequence
  gRNA target sequence
ccgaacccccttcgaccttgccg

SEQ ID NO: 1233 - DNA, 23 bp, Artificial Sequence
  gRNA target sequence
cccccttcgaccttgccgaaggg

SEQ ID NO: 1234 - DNA, 23 bp, Artificial Sequence
  gRNA target sequence
ccccttcgaccttgccgaagggg

SEQ ID NO: 1235 - DNA, 23 bp, Artificial Sequence
  gRNA target sequence
cccttcgaccttgccgaagggga

SEQ ID NO: 1236 - DNA, 23 bp, Artificial Sequence
  gRNA target sequence
ccttcgaccttgccgaaggggag

SEQ ID NO: 1237 - DNA, 23 bp, Artificial Sequence
  gRNA target sequence
ccttgccgaaggggagtccgaac

SEQ ID NO: 1238 - DNA, 23 bp, Artificial Sequence
  gRNA target sequence
ccgaaggggagtccgaactagtc

SEQ ID NO: 1239 - DNA, 23 bp, Artificial Sequence
  gRNA target sequence
ccgaactagtctcaggcttcaac

SEQ ID NO: 1240 - DNA, 23 bp, Artificial Sequence
  gRNA target sequence
ccgcaggccccttcgccctattc

SEQ ID NO: 1241 - DNA, 23 bp, Artificial Sequence
  gRNA target sequence
ccccttcgccctattcttcatag

SEQ ID NO: 1242 - DNA, 23 bp, Artificial Sequence
  gRNA target sequence
cccttcgccctattcttcatagc

SEQ ID NO: 1243 - DNA, 23 bp, Artificial Sequence
  gRNA target sequence
ccttcgccctattcttcatagcc

SEQ ID NO: 1244 - DNA, 23 bp, Artificial Sequence
  gRNA target sequence
ccctattcttcatagccgaatac

SEQ ID NO: 1245 - DNA, 23 bp, Artificial Sequence
  gRNA target sequence
cctattcttcatagccgaataca

SEQ ID NO: 1246 - DNA, 23 bp, Artificial Sequence
  gRNA target sequence
ccgaatacacaaacattattata

SEQ ID NO: 1247 - DNA, 23 bp, Artificial Sequence
  gRNA target sequence
ccctcaccactacaatcttccta

SEQ ID NO: 1248 - DNA, 23 bp, Artificial Sequence
  gRNA target sequence
cctcaccactacaatcttcctag

SEQ ID NO: 1249 - DNA, 23 bp, Artificial Sequence
  gRNA target sequence
ccactacaatcttcctaggaaca

SEQ ID NO: 1250 - DNA, 23 bp, Artificial Sequence
  gRNA target sequence
cctaggaacaacatatgacgcac

SEQ ID NO: 1251 - DNA, 23 bp, Artificial Sequence
  gRNA target sequence
cccctgaactctacacaacatat

SEQ ID NO: 1252 - DNA, 23 bp, Artificial Sequence
  gRNA target sequence
ccctgaactctacacaacatatt

SEQ ID NO: 1253 - DNA, 23 bp, Artificial Sequence
  gRNA target sequence
cctgaactctacacaacatattt

SEQ ID NO: 1254 - DNA, 23 bp, Artificial Sequence
  gRNA target sequence
ccaagaccctacttctaacctcc

SEQ ID NO: 1255 - DNA, 23 bp, Artificial Sequence
  gRNA target sequence
ccctacttctaacctccctgttc

SEQ ID NO: 1256 - DNA, 23 bp, Artificial Sequence
  gRNA target sequence
cctacttctaacctccctgttct

SEQ ID NO: 1257 - DNA, 23 bp, Artificial Sequence
  gRNA target sequence
cctccctgttcttatgaattcga

SEQ ID NO: 1258 - DNA, 23 bp, Artificial Sequence
  gRNA target sequence
ccctgttcttatgaattcgaaca

SEQ ID NO: 1259 - DNA, 23 bp, Artificial Sequence
  gRNA target sequence
cctgttcttatgaattcgaacag

SEQ ID NO: 1260 - DNA, 23 bp, Artificial Sequence
  gRNA target sequence
cccccgattccgctacgaccaac

SEQ ID NO: 1261 - DNA, 23 bp, Artificial Sequence
  gRNA target sequence
ccccgattccgctacgaccaact

SEQ ID NO: 1262 - DNA, 23 bp, Artificial Sequence
  gRNA target sequence
cccgattccgctacgaccaactc

SEQ ID NO: 1263 - DNA, 23 bp, Artificial Sequence
  gRNA target sequence
ccgattccgctacgaccaactca

SEQ ID NO: 1264 - DNA, 23 bp, Artificial Sequence
  gRNA target sequence
ccgctacgaccaactcatacacc

SEQ ID NO: 1265 - DNA, 23 bp, Artificial Sequence
  gRNA target sequence
ccaactcatacacctcctatgaa

SEQ ID NO: 1266 - DNA, 23 bp, Artificial Sequence
  gRNA target sequence
cctcctatgaaaaaacttcctac

SEQ ID NO: 1267 - DNA, 23 bp, Artificial Sequence
  gRNA target sequence
cctatgaaaaaacttcctaccac

SEQ ID NO: 1268 - DNA, 23 bp, Artificial Sequence
  gRNA target sequence
cctaccactcaccctagcattac

SEQ ID NO: 1269 - DNA, 23 bp, Artificial Sequence
  gRNA target sequence
ccactcaccctagcattacttat

SEQ ID NO: 1270 - DNA, 23 bp, Artificial Sequence
  gRNA target sequence
ccctagcattacttatatgatat

SEQ ID NO: 1271 - DNA, 23 bp, Artificial Sequence
  gRNA target sequence
cctagcattacttatatgatatg

SEQ ID NO: 1272 - DNA, 23 bp, Artificial Sequence
  gRNA target sequence
ccatacccattacaatctccagc

SEQ ID NO: 1273 - DNA, 23 bp, Artificial Sequence
  gRNA target sequence
cccattacaatctccagcattcc

SEQ ID NO: 1274 - DNA, 23 bp, Artificial Sequence
  gRNA target sequence
ccattacaatctccagcattccc

SEQ ID NO: 1275 - DNA, 23 bp, Artificial Sequence
  gRNA target sequence
ccagcattccccctcaaacctaa

SEQ ID NO: 1276 - DNA, 23 bp, Artificial Sequence
  gRNA target sequence
ccccctcaaacctaagaaatatg

SEQ ID NO: 1277 - DNA, 23 bp, Artificial Sequence
  gRNA target sequence
cccctcaaacctaagaaatatgt

SEQ ID NO: 1278 - DNA, 23 bp, Artificial Sequence
  gRNA target sequence
ccctcaaacctaagaaatatgtc

SEQ ID NO: 1279 - DNA, 23 bp, Artificial Sequence
  gRNA target sequence
cctcaaacctaagaaatatgtct

SEQ ID NO: 1280 - DNA, 23 bp, Artificial Sequence
  gRNA target sequence
cctaagaaatatgtctgataaaa

SEQ ID NO: 1281 - DNA, 23 bp, Artificial Sequence
  gRNA target sequence
cccccttatttctaggactatga

SEQ ID NO: 1282 - DNA, 23 bp, Artificial Sequence
  gRNA target sequence
ccccttatttctaggactatgag

SEQ ID NO: 1283 - DNA, 23 bp, Artificial Sequence
  gRNA target sequence
cccttatttctaggactatgaga

SEQ ID NO: 1284 - DNA, 23 bp, Artificial Sequence
  gRNA target sequence
ccttatttctaggactatgagaa

SEQ ID NO: 1285 - DNA, 23 bp, Artificial Sequence
  gRNA target sequence
cccatccctgagaatccaaaatt

SEQ ID NO: 1286 - DNA, 23 bp, Artificial Sequence
  gRNA target sequence
ccatccctgagaatccaaaattc

SEQ ID NO: 1287 - DNA, 23 bp, Artificial Sequence
  gRNA target sequence
ccctgagaatccaaaattctccg

SEQ ID NO: 1288 - DNA, 23 bp, Artificial Sequence
  gRNA target sequence
cctgagaatccaaaattctccgt

SEQ ID NO: 1289 - DNA, 23 bp, Artificial Sequence
  gRNA target sequence
ccaaaattctccgtgccacctat

SEQ ID NO: 1290 - DNA, 23 bp, Artificial Sequence
  gRNA target sequence
ccgtgccacctatcacaccccat

SEQ ID NO: 1291 - DNA, 23 bp, Artificial Sequence
  gRNA target sequence
ccacctatcacaccccatcctaa

SEQ ID NO: 1292 - DNA, 23 bp, Artificial Sequence
  gRNA target sequence
cctatcacaccccatcctaaagt

SEQ ID NO: 1293 - DNA, 23 bp, Artificial Sequence
  gRNA target sequence
ccccatcctaaagtaaggtcagc

SEQ ID NO: 1294 - DNA, 23 bp, Artificial Sequence
  gRNA target sequence
cccatcctaaagtaaggtcagct

SEQ ID NO: 1295 - DNA, 23 bp, Artificial Sequence
  gRNA target sequence
ccatcctaaagtaaggtcagcta

SEQ ID NO: 1296 - DNA, 23 bp, Artificial Sequence
  gRNA target sequence
cctaaagtaaggtcagctaaata

SEQ ID NO: 1297 - DNA, 23 bp, Artificial Sequence
  gRNA target sequence
cccataccccgaaaatgttggtt

SEQ ID NO: 1298 - DNA, 23 bp, Artificial Sequence
  gRNA target sequence
ccataccccgaaaatgttggtta

SEQ ID NO: 1299 - DNA, 23 bp, Artificial Sequence
  gRNA target sequence
ccccgaaaatgttggttataccc

SEQ ID NO: 1300 - DNA, 23 bp, Artificial Sequence
  gRNA target sequence
cccgaaaatgttggttataccct

SEQ ID NO: 1301 - DNA, 23 bp, Artificial Sequence
  gRNA target sequence
ccgaaaatgttggttataccctt

SEQ ID NO: 1302 - DNA, 23 bp, Artificial Sequence
  gRNA target sequence
cccttcccgtactaattaatccc

SEQ ID NO: 1303 - DNA, 23 bp, Artificial Sequence
  gRNA target sequence
ccttcccgtactaattaatcccc

SEQ ID NO: 1304 - DNA, 23 bp, Artificial Sequence
  gRNA target sequence
cccgtactaattaatcccctggc

SEQ ID NO: 1305 - DNA, 23 bp, Artificial Sequence
  gRNA target sequence
ccgtactaattaatcccctggcc

SEQ ID NO: 1306 - DNA, 23 bp, Artificial Sequence
  gRNA target sequence
cccctggcccaacccgtcatcta

SEQ ID NO: 1307 - DNA, 23 bp, Artificial Sequence
  gRNA target sequence
ccctggcccaacccgtcatctac

SEQ ID NO: 1308 - DNA, 23 bp, Artificial Sequence
  gRNA target sequence
cctggcccaacccgtcatctact

SEQ ID NO: 1309 - DNA, 23 bp, Artificial Sequence
  gRNA target sequence
cccaacccgtcatctactctacc

SEQ ID NO: 1310 - DNA, 23 bp, Artificial Sequence
  gRNA target sequence
ccaacccgtcatctactctacca

SEQ ID NO: 1311 - DNA, 23 bp, Artificial Sequence
  gRNA target sequence
cccgtcatctactctaccatctt

SEQ ID NO: 1312 - DNA, 23 bp, Artificial Sequence
  gRNA target sequence
ccgtcatctactctaccatcttt

SEQ ID NO: 1313 - DNA, 23 bp, Artificial Sequence
  gRNA target sequence
ccatctttgcaggcacactcatc

SEQ ID NO: 1314 - DNA, 23 bp, Artificial Sequence
  gRNA target sequence
cctgagtaggcctagaaataaac

SEQ ID NO: 1315 - DNA, 23 bp, Artificial Sequence
  gRNA target sequence
cctagaaataaacatgctagctt

SEQ ID NO: 1316 - DNA, 23 bp, Artificial Sequence
  gRNA target sequence
ccagttctaaccaaaaaaataaa

SEQ ID NO: 1317 - DNA, 23 bp, Artificial Sequence
  gRNA target sequence
ccaaaaaaataaaccctcgttcc

SEQ ID NO: 1318 - DNA, 23 bp, Artificial Sequence
  gRNA target sequence
ccctcgttccacagaagctgcca

SEQ ID NO: 1319 - DNA, 23 bp, Artificial Sequence
  gRNA target sequence
cctcgttccacagaagctgccat

SEQ ID NO: 1320 - DNA, 23 bp, Artificial Sequence
  gRNA target sequence
ccacagaagctgccatcaagtat

SEQ ID NO: 1321 - DNA, 23 bp, Artificial Sequence
  gRNA target sequence
ccatcaagtatttcctcacgcaa

SEQ ID NO: 1322 - DNA, 23 bp, Artificial Sequence
  gRNA target sequence
cctcacgcaagcaaccgcatcca

SEQ ID NO: 1323 - DNA, 23 bp, Artificial Sequence
  gRNA target sequence
ccgcatccataatccttctaata

SEQ ID NO: 1324 - DNA, 23 bp, Artificial Sequence
  gRNA target sequence
ccataatccttctaatagctatc

SEQ ID NO: 1325 - DNA, 23 bp, Artificial Sequence
  gRNA target sequence
ccttctaatagctatcctcttca

SEQ ID NO: 1326 - DNA, 23 bp, Artificial Sequence
  gRNA target sequence
cctcttcaacaatatactctccg

SEQ ID NO: 1327 - DNA, 23 bp, Artificial Sequence
  gRNA target sequence
ccggacaatgaaccataaccaat

SEQ ID NO: 1328 - DNA, 23 bp, Artificial Sequence
  gRNA target sequence
ccataaccaatactaccaatcaa

SEQ ID NO: 1329 - DNA, 23 bp, Artificial Sequence
  gRNA target sequence
ccaatactaccaatcaatactca

SEQ ID NO: 1330 - DNA, 23 bp, Artificial Sequence
  gRNA target sequence
ccaatcaatactcatcattaata

SEQ ID NO: 1331 - DNA, 23 bp, Artificial Sequence
  gRNA target sequence
ccccctttcacttctgagtccca

SEQ ID NO: 1332 - DNA, 23 bp, Artificial Sequence
  gRNA target sequence
cccctttcacttctgagtcccag

SEQ ID NO: 1333 - DNA, 23 bp, Artificial Sequence
  gRNA target sequence
ccctttcacttctgagtcccaga

SEQ ID NO: 1334 - DNA, 23 bp, Artificial Sequence
  gRNA target sequence
cctttcacttctgagtcccagag

SEQ ID NO: 1335 - DNA, 23 bp, Artificial Sequence
  gRNA target sequence
cccagaggttacccaaggcaccc

SEQ ID NO: 1336 - DNA, 23 bp, Artificial Sequence
  gRNA target sequence
ccagaggttacccaaggcacccc

SEQ ID NO: 1337 - DNA, 23 bp, Artificial Sequence
  gRNA target sequence
cccaaggcacccctctgacatcc

SEQ ID NO: 1338 - DNA, 23 bp, Artificial Sequence
  gRNA target sequence
ccaaggcacccctctgacatccg

SEQ ID NO: 1339 - DNA, 23 bp, Artificial Sequence
  gRNA target sequence
cccctctgacatccggcctgctt

SEQ ID NO: 1340 - DNA, 23 bp, Artificial Sequence
  gRNA target sequence
ccctctgacatccggcctgcttc

SEQ ID NO: 1341 - DNA, 23 bp, Artificial Sequence
  gRNA target sequence
cctctgacatccggcctgcttct

SEQ ID NO: 1342 - DNA, 23 bp, Artificial Sequence
  gRNA target sequence
ccggcctgcttcttctcacatga

SEQ ID NO: 1343 - DNA, 23 bp, Artificial Sequence
  gRNA target sequence
cctgcttcttctcacatgacaaa

SEQ ID NO: 1344 - DNA, 23 bp, Artificial Sequence
  gRNA target sequence
cccccatctcaatcatataccaa

SEQ ID NO: 1345 - DNA, 23 bp, Artificial Sequence
  gRNA target sequence
ccccatctcaatcatataccaaa

SEQ ID NO: 1346 - DNA, 23 bp, Artificial Sequence
  gRNA target sequence
cccatctcaatcatataccaaat

SEQ ID NO: 1347 - DNA, 23 bp, Artificial Sequence
  gRNA target sequence
ccatctcaatcatataccaaatc

SEQ ID NO: 1348 - DNA, 23 bp, Artificial Sequence
  gRNA target sequence
ccaaatctctccctcactaaacg

SEQ ID NO: 1349 - DNA, 23 bp, Artificial Sequence
  gRNA target sequence
ccctcactaaacgtaagccttct

SEQ ID NO: 1350 - DNA, 23 bp, Artificial Sequence
  gRNA target sequence
cctcactaaacgtaagccttctc

SEQ ID NO: 1351 - DNA, 23 bp, Artificial Sequence
  gRNA target sequence
ccttctcctcactctctcaatct

SEQ ID NO: 1352 - DNA, 23 bp, Artificial Sequence
  gRNA target sequence
cctcactctctcaatcttatcca

SEQ ID NO: 1353 - DNA, 23 bp, Artificial Sequence
  gRNA target sequence
ccatcatagcaggcagttgaggt

SEQ ID NO: 1354 - DNA, 23 bp, Artificial Sequence
  gRNA target sequence
ccaaacccagctacgcaaaatct

SEQ ID NO: 1355 - DNA, 23 bp, Artificial Sequence
  gRNA target sequence
cccagctacgcaaaatcttagca

SEQ ID NO: 1356 - DNA, 23 bp, Artificial Sequence
  gRNA target sequence
ccagctacgcaaaatcttagcat

SEQ ID NO: 1357 - DNA, 23 bp, Artificial Sequence
  gRNA target sequence
cctcaattacccacataggatga

SEQ ID NO: 1358 - DNA, 23 bp, Artificial Sequence
  gRNA target sequence
cccacataggatgaataatagca

SEQ ID NO: 1359 - DNA, 23 bp, Artificial Sequence
  gRNA target sequence
ccacataggatgaataatagcag

SEQ ID NO: 1360 - DNA, 23 bp, Artificial Sequence
  gRNA target sequence
ccgtacaaccctaacataaccat

SEQ ID NO: 1361 - DNA, 23 bp, Artificial Sequence
  gRNA target sequence
ccctaacataaccattcttaatt

SEQ ID NO: 1362 - DNA, 23 bp, Artificial Sequence
  gRNA target sequence
cctaacataaccattcttaattt

SEQ ID NO: 1363 - DNA, 23 bp, Artificial Sequence
  gRNA target sequence
ccattcttaatttaactatttat

SEQ ID NO: 1364 - DNA, 23 bp, Artificial Sequence
  gRNA target sequence
cctaactactaccgcattcctac

SEQ ID NO: 1365 - DNA, 23 bp, Artificial Sequence
  gRNA target sequence
ccgcattcctactactcaactta

SEQ ID NO: 1366 - DNA, 23 bp, Artificial Sequence
  gRNA target sequence
cctactactcaacttaaactcca

SEQ ID NO: 1367 - DNA, 23 bp, Artificial Sequence
  gRNA target sequence
ccagcaccacgaccctactacta

SEQ ID NO: 1368 - DNA, 23 bp, Artificial Sequence
  gRNA target sequence
ccacgaccctactactatctcgc

SEQ ID NO: 1369 - DNA, 23 bp, Artificial Sequence
  gRNA target sequence
ccctactactatctcgcacctga

SEQ ID NO: 1370 - DNA, 23 bp, Artificial Sequence
  gRNA target sequence
cctactactatctcgcacctgaa

SEQ ID NO: 1371 - DNA, 23 bp, Artificial Sequence
  gRNA target sequence
cctgaaacaagctaacatgacta

SEQ ID NO: 1372 - DNA, 23 bp, Artificial Sequence
  gRNA target sequence
cccttaattccatccaccctcct

SEQ ID NO: 1373 - DNA, 23 bp, Artificial Sequence
  gRNA target sequence
ccttaattccatccaccctcctc

SEQ ID NO: 1374 - DNA, 23 bp, Artificial Sequence
  gRNA target sequence
ccatccaccctcctctccctagg

SEQ ID NO: 1375 - DNA, 23 bp, Artificial Sequence
  gRNA target sequence
ccaccctcctctccctaggaggc

SEQ ID NO: 1376 - DNA, 23 bp, Artificial Sequence
  gRNA target sequence
ccctcctctccctaggaggcctg

SEQ ID NO: 1377 - DNA, 23 bp, Artificial Sequence
  gRNA target sequence
cctcctctccctaggaggcctgc

SEQ ID NO: 1378 - DNA, 23 bp, Artificial Sequence
  gRNA target sequence
cctctccctaggaggcctgcccc

SEQ ID NO: 1379 - DNA, 23 bp, Artificial Sequence
  gRNA target sequence
ccctaggaggcctgcccccgcta

SEQ ID NO: 1380 - DNA, 23 bp, Artificial Sequence
  gRNA target sequence
cctaggaggcctgcccccgctaa

SEQ ID NO: 1381 - DNA, 23 bp, Artificial Sequence
  gRNA target sequence
cctgcccccgctaaccggctttt

SEQ ID NO: 1382 - DNA, 23 bp, Artificial Sequence
  gRNA target sequence
cccccgctaaccggctttttgcc

SEQ ID NO: 1383 - DNA, 23 bp, Artificial Sequence
  gRNA target sequence
ccccgctaaccggctttttgccc

SEQ ID NO: 1384 - DNA, 23 bp, Artificial Sequence
  gRNA target sequence
cccgctaaccggctttttgccca

SEQ ID NO: 1385 - DNA, 23 bp, Artificial Sequence
  gRNA target sequence
ccgctaaccggctttttgcccaa

SEQ ID NO: 1386 - DNA, 23 bp, Artificial Sequence
  gRNA target sequence
ccggctttttgcccaaatgggcc

SEQ ID NO: 1387 - DNA, 23 bp, Artificial Sequence
  gRNA target sequence
cccaaatgggccattatcgaaga

SEQ ID NO: 1388 - DNA, 23 bp, Artificial Sequence
  gRNA target sequence
ccaaatgggccattatcgaagaa

SEQ ID NO: 1389 - DNA, 23 bp, Artificial Sequence
  gRNA target sequence
ccattatcgaagaattcacaaaa

SEQ ID NO: 1390 - DNA, 23 bp, Artificial Sequence
  gRNA target sequence
cctcatcatccccaccatcatag

SEQ ID NO: 1391 - DNA, 23 bp, Artificial Sequence
  gRNA target sequence
ccccaccatcatagccaccatca

SEQ ID NO: 1392 - DNA, 23 bp, Artificial Sequence
  gRNA target sequence
cccaccatcatagccaccatcac

SEQ ID NO: 1393 - DNA, 23 bp, Artificial Sequence
  gRNA target sequence
ccaccatcatagccaccatcacc

SEQ ID NO: 1394 - DNA, 23 bp, Artificial Sequence
  gRNA target sequence
ccatcatagccaccatcaccctc

SEQ ID NO: 1395 - DNA, 23 bp, Artificial Sequence
  gRNA target sequence
ccaccatcaccctccttaacctc

SEQ ID NO: 1396 - DNA, 23 bp, Artificial Sequence
  gRNA target sequence
ccatcaccctccttaacctctac

SEQ ID NO: 1397 - DNA, 23 bp, Artificial Sequence
  gRNA target sequence
ccctccttaacctctacttctac

SEQ ID NO: 1398 - DNA, 23 bp, Artificial Sequence
  gRNA target sequence
cctccttaacctctacttctacc

SEQ ID NO: 1399 - DNA, 23 bp, Artificial Sequence
  gRNA target sequence
ccttaacctctacttctacctac

SEQ ID NO: 1400 - DNA, 23 bp, Artificial Sequence
  gRNA target sequence
cctctacttctacctacgcctaa

SEQ ID NO: 1401 - DNA, 23 bp, Artificial Sequence
  gRNA target sequence
cctacgcctaatctactccacct

SEQ ID NO: 1402 - DNA, 23 bp, Artificial Sequence
  gRNA target sequence
cctaatctactccacctcaatca

SEQ ID NO: 1403 - DNA, 23 bp, Artificial Sequence
  gRNA target sequence
ccacctcaatcacactactcccc

SEQ ID NO: 1404 - DNA, 23 bp, Artificial Sequence
  gRNA target sequence
cctcaatcacactactccccata

SEQ ID NO: 1405 - DNA, 23 bp, Artificial Sequence
  gRNA target sequence
ccccatatctaacaacgtaaaaa

SEQ ID NO: 1406 - DNA, 23 bp, Artificial Sequence
  gRNA target sequence
cccatatctaacaacgtaaaaat

SEQ ID NO: 1407 - DNA, 23 bp, Artificial Sequence
  gRNA target sequence
ccatatctaacaacgtaaaaata

SEQ ID NO: 1408 - DNA, 23 bp, Artificial Sequence
  gRNA target sequence
cccaccccattcctccccacact

SEQ ID NO: 1409 - DNA, 23 bp, Artificial Sequence
  gRNA target sequence
ccaccccattcctccccacactc

SEQ ID NO: 1410 - DNA, 23 bp, Artificial Sequence
  gRNA target sequence
ccccattcctccccacactcatc

SEQ ID NO: 1411 - DNA, 23 bp, Artificial Sequence
  gRNA target sequence
cccattcctccccacactcatcg

SEQ ID NO: 1412 - DNA, 23 bp, Artificial Sequence
  gRNA target sequence
ccattcctccccacactcatcgc

SEQ ID NO: 1413 - DNA, 23 bp, Artificial Sequence
  gRNA target sequence
cctccccacactcatcgccctta

SEQ ID NO: 1414 - DNA, 23 bp, Artificial Sequence
  gRNA target sequence
ccccacactcatcgcccttacca

SEQ ID NO: 1415 - DNA, 23 bp, Artificial Sequence
  gRNA target sequence
cccacactcatcgcccttaccac

SEQ ID NO: 1416 - DNA, 23 bp, Artificial Sequence
  gRNA target sequence
ccacactcatcgcccttaccacg

SEQ ID NO: 1417 - DNA, 23 bp, Artificial Sequence
  gRNA target sequence
cccttaccacgctactcctacct

SEQ ID NO: 1418 - DNA, 23 bp, Artificial Sequence
  gRNA target sequence
ccttaccacgctactcctaccta

SEQ ID NO: 1419 - DNA, 23 bp, Artificial Sequence
  gRNA target sequence
ccacgctactcctacctatctcc

SEQ ID NO: 1420 - DNA, 23 bp, Artificial Sequence
  gRNA target sequence
cctacctatctccccttttatac

SEQ ID NO: 1421 - DNA, 23 bp, Artificial Sequence
  gRNA target sequence
cctatctccccttttatactaat

SEQ ID NO: 1422 - DNA, 23 bp, Artificial Sequence
  gRNA target sequence
ccccttttatactaataatctta

SEQ ID NO: 1423 - DNA, 23 bp, Artificial Sequence
  gRNA target sequence
cccttttatactaataatcttat

SEQ ID NO: 1424 - DNA, 23 bp, Artificial Sequence
  gRNA target sequence
ccttttatactaataatcttata

SEQ ID NO: 1425 - DNA, 23 bp, Artificial Sequence
  gRNA target sequence
ccaagagccttcaaagccctcag

SEQ ID NO: 1426 - DNA, 23 bp, Artificial Sequence
  gRNA target sequence
ccttcaaagccctcagtaagttg

SEQ ID NO: 1427 - DNA, 23 bp, Artificial Sequence
  gRNA target sequence
ccctcagtaagttgcaatactta

SEQ ID NO: 1428 - DNA, 23 bp, Artificial Sequence
  gRNA target sequence
cctcagtaagttgcaatacttaa

SEQ ID NO: 1429 - DNA, 23 bp, Artificial Sequence
  gRNA target sequence
ccccactctgcatcaactgaacg

SEQ ID NO: 1430 - DNA, 23 bp, Artificial Sequence
  gRNA target sequence
cccactctgcatcaactgaacgc

SEQ ID NO: 1431 - DNA, 23 bp, Artificial Sequence
  gRNA target sequence
ccactctgcatcaactgaacgca

SEQ ID NO: 1432 - DNA, 23 bp, Artificial Sequence
  gRNA target sequence
ccactttaattaagctaagccct

SEQ ID NO: 1433 - DNA, 23 bp, Artificial Sequence
  gRNA target sequence
cccttactagaccaatgggactt

SEQ ID NO: 1434 - DNA, 23 bp, Artificial Sequence
  gRNA target sequence
ccttactagaccaatgggactta

SEQ ID NO: 1435 - DNA, 23 bp, Artificial Sequence
  gRNA target sequence
ccaatgggacttaaacccacaaa

SEQ ID NO: 1436 - DNA, 23 bp, Artificial Sequence
  gRNA target sequence
cccacaaacacttagttaacagc

SEQ ID NO: 1437 - DNA, 23 bp, Artificial Sequence
  gRNA target sequence
ccacaaacacttagttaacagct

SEQ ID NO: 1438 - DNA, 23 bp, Artificial Sequence
  gRNA target sequence
ccctaatcaactggcttcaatct

SEQ ID NO: 1439 - DNA, 23 bp, Artificial Sequence
  gRNA target sequence
cctaatcaactggcttcaatcta

SEQ ID NO: 1440 - DNA, 23 bp, Artificial Sequence
  gRNA target sequence
cccgccgccgggaaaaaaggcgg

SEQ ID NO: 1441 - DNA, 23 bp, Artificial Sequence
  gRNA target sequence
ccgccgccgggaaaaaaggcggg

SEQ ID NO: 1442 - DNA, 23 bp, Artificial Sequence
  gRNA target sequence
ccgccgggaaaaaaggcgggaga

SEQ ID NO: 1443 - DNA, 23 bp, Artificial Sequence
  gRNA target sequence
ccgggaaaaaaggcgggagaagc

SEQ ID NO: 1444 - DNA, 23 bp, Artificial Sequence
  gRNA target sequence
ccccggcaggtttgaagctgctt

SEQ ID NO: 1445 - DNA, 23 bp, Artificial Sequence
  gRNA target sequence
cccggcaggtttgaagctgcttc

SEQ ID NO: 1446 - DNA, 23 bp, Artificial Sequence
  gRNA target sequence
ccggcaggtttgaagctgcttct

SEQ ID NO: 1447 - DNA, 23 bp, Artificial Sequence
  gRNA target sequence
cctcggagctggtaaaaagaggc

SEQ ID NO: 1448 - DNA, 23 bp, Artificial Sequence
  gRNA target sequence
cctaacccctgtctttagattta

SEQ ID NO: 1449 - DNA, 23 bp, Artificial Sequence
  gRNA target sequence
cccctgtctttagatttacagtc

SEQ ID NO: 1450 - DNA, 23 bp, Artificial Sequence
  gRNA target sequence
ccctgtctttagatttacagtcc

SEQ ID NO: 1451 - DNA, 23 bp, Artificial Sequence
  gRNA target sequence
cctgtctttagatttacagtcca

SEQ ID NO: 1452 - DNA, 23 bp, Artificial Sequence
  gRNA target sequence
ccaatgcttcactcagccatttt

SEQ ID NO: 1453 - DNA, 23 bp, Artificial Sequence
  gRNA target sequence
ccattttacctcacccccactga

SEQ ID NO: 1454 - DNA, 23 bp, Artificial Sequence
  gRNA target sequence
cctcacccccactgatgttcgcc

SEQ ID NO: 1455 - DNA, 23 bp, Artificial Sequence
  gRNA target sequence
cccccactgatgttcgccgaccg

SEQ ID NO: 1456 - DNA, 23 bp, Artificial Sequence
  gRNA target sequence
ccccactgatgttcgccgaccgt

SEQ ID NO: 1457 - DNA, 23 bp, Artificial Sequence
  gRNA target sequence
cccactgatgttcgccgaccgtt

SEQ ID NO: 1458 - DNA, 23 bp, Artificial Sequence
  gRNA target sequence
ccactgatgttcgccgaccgttg

SEQ ID NO: 1459 - DNA, 23 bp, Artificial Sequence
  gRNA target sequence
ccgaccgttgactattctctaca

SEQ ID NO: 1460 - DNA, 23 bp, Artificial Sequence
  gRNA target sequence
ccgttgactattctctacaaacc

SEQ ID NO: 1461 - DNA, 23 bp, Artificial Sequence
  gRNA target sequence
ccacaaagacattggaacactat

SEQ ID NO: 1462 - DNA, 23 bp, Artificial Sequence
  gRNA target sequence
cctattattcggcgcatgagctg

SEQ ID NO: 1463 - DNA, 23 bp, Artificial Sequence
  gRNA target sequence
cctaggcacagctctaagcctcc

SEQ ID NO: 1464 - DNA, 23 bp, Artificial Sequence
  gRNA target sequence
cctccttattcgagccgagctgg

SEQ ID NO: 1465 - DNA, 23 bp, Artificial Sequence
  gRNA target sequence
ccttattcgagccgagctgggcc

SEQ ID NO: 1466 - DNA, 23 bp, Artificial Sequence
  gRNA target sequence
ccgagctgggccagccaggcaac

SEQ ID NO: 1467 - DNA, 23 bp, Artificial Sequence
  gRNA target sequence
ccagccaggcaaccttctaggta

SEQ ID NO: 1468 - DNA, 23 bp, Artificial Sequence
  gRNA target sequence
ccaggcaaccttctaggtaacga

SEQ ID NO: 1469 - DNA, 23 bp, Artificial Sequence
  gRNA target sequence
ccttctaggtaacgaccacatct

SEQ ID NO: 1470 - DNA, 23 bp, Artificial Sequence
  gRNA target sequence
ccacatctacaacgttatcgtca

SEQ ID NO: 1471 - DNA, 23 bp, Artificial Sequence
  gRNA target sequence
cccatgcatttgtaataatcttc

SEQ ID NO: 1472 - DNA, 23 bp, Artificial Sequence
  gRNA target sequence
ccatgcatttgtaataatcttct

SEQ ID NO: 1473 - DNA, 23 bp, Artificial Sequence
  gRNA target sequence
cccatcataatcggaggctttgg

SEQ ID NO: 1474 - DNA, 23 bp, Artificial Sequence
  gRNA target sequence
ccatcataatcggaggctttggc

SEQ ID NO: 1475 - DNA, 23 bp, Artificial Sequence
  gRNA target sequence
cccctaataatcggtgcccccga

SEQ ID NO: 1476 - DNA, 23 bp, Artificial Sequence
  gRNA target sequence
ccctaataatcggtgcccccgat

SEQ ID NO: 1477 - DNA, 23 bp, Artificial Sequence
  gRNA target sequence
cctaataatcggtgcccccgata

SEQ ID NO: 1478 - DNA, 23 bp, Artificial Sequence
  gRNA target sequence
cccccgatatggcgtttccccgc

SEQ ID NO: 1479 - DNA, 23 bp, Artificial Sequence
  gRNA target sequence
ccccgatatggcgtttccccgca

SEQ ID NO: 1480 - DNA, 23 bp, Artificial Sequence
  gRNA target sequence
cccgatatggcgtttccccgcat

SEQ ID NO: 1481 - DNA, 23 bp, Artificial Sequence
  gRNA target sequence
ccgatatggcgtttccccgcata

SEQ ID NO: 1482 - DNA, 23 bp, Artificial Sequence
  gRNA target sequence
ccccgcataaacaacataagctt

SEQ ID NO: 1483 - DNA, 23 bp, Artificial Sequence
  gRNA target sequence
cccgcataaacaacataagcttc

SEQ ID NO: 1484 - DNA, 23 bp, Artificial Sequence
  gRNA target sequence
ccgcataaacaacataagcttct

SEQ ID NO: 1485 - DNA, 23 bp, Artificial Sequence
  gRNA target sequence
cctccctctctcctactcctgct

SEQ ID NO: 1486 - DNA, 23 bp, Artificial Sequence
  gRNA target sequence
ccctctctcctactcctgctcgc

SEQ ID NO: 1487 - DNA, 23 bp, Artificial Sequence
  gRNA target sequence
cctctctcctactcctgctcgca

SEQ ID NO: 1488 - DNA, 23 bp, Artificial Sequence
  gRNA target sequence
cctactcctgctcgcatctgcta

SEQ ID NO: 1489 - DNA, 23 bp, Artificial Sequence
  gRNA target sequence
cctgctcgcatctgctatagtgg

SEQ ID NO: 1490 - DNA, 23 bp, Artificial Sequence
  gRNA target sequence
ccggagcaggaacaggttgaaca

SEQ ID NO: 1491 - DNA, 23 bp, Artificial Sequence
  gRNA target sequence
ccctcccttagcagggaactact

SEQ ID NO: 1492 - DNA, 23 bp, Artificial Sequence
  gRNA target sequence
cctcccttagcagggaactactc

SEQ ID NO: 1493 - DNA, 23 bp, Artificial Sequence
  gRNA target sequence
cccttagcagggaactactccca

SEQ ID NO: 1494 - DNA, 23 bp, Artificial Sequence
  gRNA target sequence
ccttagcagggaactactcccac

SEQ ID NO: 1495 - DNA, 23 bp, Artificial Sequence
  gRNA target sequence
cccaccctggagcctccgtagac

SEQ ID NO: 1496 - DNA, 23 bp, Artificial Sequence
  gRNA target sequence
ccaccctggagcctccgtagacc

SEQ ID NO: 1497 - DNA, 23 bp, Artificial Sequence
  gRNA target sequence
ccctggagcctccgtagacctaa

SEQ ID NO: 1498 - DNA, 23 bp, Artificial Sequence
  gRNA target sequence
cctggagcctccgtagacctaac

SEQ ID NO: 1499 - DNA, 23 bp, Artificial Sequence
  gRNA target sequence
cctccgtagacctaaccatcttc

SEQ ID NO: 1500 - DNA, 23 bp, Artificial Sequence
  gRNA target sequence
ccgtagacctaaccatcttctcc

SEQ ID NO: 1501 - DNA, 23 bp, Artificial Sequence
  gRNA target sequence
cctaaccatcttctccttacacc

SEQ ID NO: 1502 - DNA, 23 bp, Artificial Sequence
  gRNA target sequence
ccatcttctccttacacctagca

SEQ ID NO: 1503 - DNA, 23 bp, Artificial Sequence
  gRNA target sequence
ccttacacctagcaggtgtctcc

SEQ ID NO: 1504 - DNA, 23 bp, Artificial Sequence
  gRNA target sequence
cctagcaggtgtctcctctatct

SEQ ID NO: 1505 - DNA, 23 bp, Artificial Sequence
  gRNA target sequence
cctctatcttaggggccatcaat

SEQ ID NO: 1506 - DNA, 23 bp, Artificial Sequence
  gRNA target sequence
ccatcaatttcatcacaacaatt

SEQ ID NO: 1507 - DNA, 23 bp, Artificial Sequence
  gRNA target sequence
ccccctgccataacccaatacca

SEQ ID NO: 1508 - DNA, 23 bp, Artificial Sequence
  gRNA target sequence
cccctgccataacccaataccaa

SEQ ID NO: 1509 - DNA, 23 bp, Artificial Sequence
  gRNA target sequence
ccctgccataacccaataccaaa

SEQ ID NO: 1510 - DNA, 23 bp, Artificial Sequence
  gRNA target sequence
cctgccataacccaataccaaac

SEQ ID NO: 1511 - DNA, 23 bp, Artificial Sequence
  gRNA target sequence
ccataacccaataccaaacgccc

SEQ ID NO: 1512 - DNA, 23 bp, Artificial Sequence
  gRNA target sequence
cccaataccaaacgcccctcttc

SEQ ID NO: 1513 - DNA, 23 bp, Artificial Sequence
  gRNA target sequence
ccaataccaaacgcccctcttcg

SEQ ID NO: 1514 - DNA, 23 bp, Artificial Sequence
  gRNA target sequence
ccaaacgcccctcttcgtctgat

SEQ ID NO: 1515 - DNA, 23 bp, Artificial Sequence
  gRNA target sequence
cccctcttcgtctgatccgtcct

SEQ ID NO: 1516 - DNA, 23 bp, Artificial Sequence
  gRNA target sequence
ccctcttcgtctgatccgtccta

SEQ ID NO: 1517 - DNA, 23 bp, Artificial Sequence
  gRNA target sequence
cctcttcgtctgatccgtcctaa

SEQ ID NO: 1518 - DNA, 23 bp, Artificial Sequence
  gRNA target sequence
ccgtcctaatcacagcagtccta

SEQ ID NO: 1519 - DNA, 23 bp, Artificial Sequence
  gRNA target sequence
cctaatcacagcagtcctacttc

SEQ ID NO: 1520 - DNA, 23 bp, Artificial Sequence
  gRNA target sequence
cctacttctcctatctctcccag

SEQ ID NO: 1521 - DNA, 23 bp, Artificial Sequence
  gRNA target sequence
cctatctctcccagtcctagctg

SEQ ID NO: 1522 - DNA, 23 bp, Artificial Sequence
  gRNA target sequence
cccagtcctagctgctggcatca

SEQ ID NO: 1523 - DNA, 23 bp, Artificial Sequence
  gRNA target sequence
ccagtcctagctgctggcatcac

SEQ ID NO: 1524 - DNA, 23 bp, Artificial Sequence
  gRNA target sequence
cctagctgctggcatcactatac

SEQ ID NO: 1525 - DNA, 23 bp, Artificial Sequence
  gRNA target sequence
ccgcaacctcaacaccaccttct

SEQ ID NO: 1526 - DNA, 23 bp, Artificial Sequence
  gRNA target sequence
cctcaacaccaccttcttcgacc

SEQ ID NO: 1527 - DNA, 23 bp, Artificial Sequence
  gRNA target sequence
ccaccttcttcgaccccgccgga

SEQ ID NO: 1528 - DNA, 23 bp, Artificial Sequence
  gRNA target sequence
ccttcttcgaccccgccggagga

SEQ ID NO: 1529 - DNA, 23 bp, Artificial Sequence
  gRNA target sequence
ccccgccggaggaggagacccca

SEQ ID NO: 1530 - DNA, 23 bp, Artificial Sequence
  gRNA target sequence
cccgccggaggaggagaccccat

SEQ ID NO: 1531 - DNA, 23 bp, Artificial Sequence
  gRNA target sequence
ccgccggaggaggagaccccatt

SEQ ID NO: 1532 - DNA, 23 bp, Artificial Sequence
  gRNA target sequence
ccggaggaggagaccccattcta

SEQ ID NO: 1533 - DNA, 23 bp, Artificial Sequence
  gRNA target sequence
ccccattctataccaacacctat

SEQ ID NO: 1534 - DNA, 23 bp, Artificial Sequence
  gRNA target sequence
cccattctataccaacacctatt

SEQ ID NO: 1535 - DNA, 23 bp, Artificial Sequence
  gRNA target sequence
ccattctataccaacacctattc

SEQ ID NO: 1536 - DNA, 23 bp, Artificial Sequence
  gRNA target sequence
ccaacacctattctgatttttcg

SEQ ID NO: 1537 - DNA, 23 bp, Artificial Sequence
  gRNA target sequence
cctattctgatttttcggtcacc

SEQ ID NO: 1538 - DNA, 23 bp, Artificial Sequence
  gRNA target sequence
ccctgaagtttatattcttatcc

SEQ ID NO: 1539 - DNA, 23 bp, Artificial Sequence
  gRNA target sequence
cctgaagtttatattcttatcct

SEQ ID NO: 1540 - DNA, 23 bp, Artificial Sequence
  gRNA target sequence
cctaccaggcttcggaataatct

SEQ ID NO: 1541 - DNA, 23 bp, Artificial Sequence
  gRNA target sequence
ccaggcttcggaataatctccca

SEQ ID NO: 1542 - DNA, 23 bp, Artificial Sequence
  gRNA target sequence
cccatattgtaacttactactcc

SEQ ID NO: 1543 - DNA, 23 bp, Artificial Sequence
  gRNA target sequence
ccatattgtaacttactactccg

SEQ ID NO: 1544 - DNA, 23 bp, Artificial Sequence
  gRNA target sequence
ccggaaaaaaagaaccatttgga

SEQ ID NO: 1545 - DNA, 23 bp, Artificial Sequence
  gRNA target sequence
ccatttggatacataggtatggt

SEQ ID NO: 1546 - DNA, 23 bp, Artificial Sequence
  gRNA target sequence
cctagggtttatcgtgtgagcac

SEQ ID NO: 1547 - DNA, 23 bp, Artificial Sequence
  gRNA target sequence
ccatatatttacagtaggaatag

SEQ ID NO: 1548 - DNA, 23 bp, Artificial Sequence
  gRNA target sequence
cctccgctaccataatcatcgct

SEQ ID NO: 1549 - DNA, 23 bp, Artificial Sequence
  gRNA target sequence
ccgctaccataatcatcgctatc

SEQ ID NO: 1550 - DNA, 23 bp, Artificial Sequence
  gRNA target sequence
ccataatcatcgctatccccacc

SEQ ID NO: 1551 - DNA, 23 bp, Artificial Sequence
  gRNA target sequence
ccccaccggcgtcaaagtattta

SEQ ID NO: 1552 - DNA, 23 bp, Artificial Sequence
  gRNA target sequence
cccaccggcgtcaaagtatttag

SEQ ID NO: 1553 - DNA, 23 bp, Artificial Sequence
  gRNA target sequence
ccaccggcgtcaaagtatttagc

SEQ ID NO: 1554 - DNA, 23 bp, Artificial Sequence
  gRNA target sequence
ccggcgtcaaagtatttagctga

SEQ ID NO: 1555 - DNA, 23 bp, Artificial Sequence
  gRNA target sequence
ccacactccacggaagcaatatg

SEQ ID NO: 1556 - DNA, 23 bp, Artificial Sequence
  gRNA target sequence
ccacggaagcaatatgaaatgat

SEQ ID NO: 1557 - DNA, 23 bp, Artificial Sequence
  gRNA target sequence
ccctaggattcatctttcttttc

SEQ ID NO: 1558 - DNA, 23 bp, Artificial Sequence
  gRNA target sequence
cctaggattcatctttcttttca

SEQ ID NO: 1559 - DNA, 23 bp, Artificial Sequence
  gRNA target sequence
ccgtaggtggcctgactggcatt

SEQ ID NO: 1560 - DNA, 23 bp, Artificial Sequence
  gRNA target sequence
cctgactggcattgtattagcaa

SEQ ID NO: 1561 - DNA, 23 bp, Artificial Sequence
  gRNA target sequence
cccacttccactatgtcctatca

SEQ ID NO: 1562 - DNA, 23 bp, Artificial Sequence
  gRNA target sequence
ccacttccactatgtcctatcaa

SEQ ID NO: 1563 - DNA, 23 bp, Artificial Sequence
  gRNA target sequence
ccactatgtcctatcaataggag

SEQ ID NO: 1564 - DNA, 23 bp, Artificial Sequence
  gRNA target sequence
cctatcaataggagctgtatttg

SEQ ID NO: 1565 - DNA, 23 bp, Artificial Sequence
  gRNA target sequence
ccatcataggaggcttcattcac

SEQ ID NO: 1566 - DNA, 23 bp, Artificial Sequence
  gRNA target sequence
cccctattctcaggctacaccct

SEQ ID NO: 1567 - DNA, 23 bp, Artificial Sequence
  gRNA target sequence
ccctattctcaggctacacccta

SEQ ID NO: 1568 - DNA, 23 bp, Artificial Sequence
  gRNA target sequence
cctattctcaggctacaccctag

SEQ ID NO: 1569 - DNA, 23 bp, Artificial Sequence
  gRNA target sequence
ccctagaccaaacctacgccaaa

SEQ ID NO: 1570 - DNA, 23 bp, Artificial Sequence
  gRNA target sequence
cctagaccaaacctacgccaaaa

SEQ ID NO: 1571 - DNA, 23 bp, Artificial Sequence
  gRNA target sequence
ccaaacctacgccaaaatccatt

SEQ ID NO: 1572 - DNA, 23 bp, Artificial Sequence
  gRNA target sequence
cctacgccaaaatccatttcact

SEQ ID NO: 1573 - DNA, 23 bp, Artificial Sequence
  gRNA target sequence
ccaaaatccatttcactatcata

SEQ ID NO: 1574 - DNA, 23 bp, Artificial Sequence
  gRNA target sequence
ccatttcactatcatattcatcg

SEQ ID NO: 1575 - DNA, 23 bp, Artificial Sequence
  gRNA target sequence
cccacaacactttctcggcctat

SEQ ID NO: 1576 - DNA, 23 bp, Artificial Sequence
  gRNA target sequence
ccacaacactttctcggcctatc

SEQ ID NO: 1577 - DNA, 23 bp, Artificial Sequence
  gRNA target sequence
cctatccggaatgccccgacgtt

SEQ ID NO: 1578 - DNA, 23 bp, Artificial Sequence
  gRNA target sequence
ccggaatgccccgacgttactcg

SEQ ID NO: 1579 - DNA, 23 bp, Artificial Sequence
  gRNA target sequence
ccccgacgttactcggactaccc

SEQ ID NO: 1580 - DNA, 23 bp, Artificial Sequence
  gRNA target sequence
cccgacgttactcggactacccc

SEQ ID NO: 1581 - DNA, 23 bp, Artificial Sequence
  gRNA target sequence
ccgacgttactcggactaccccg

SEQ ID NO: 1582 - DNA, 23 bp, Artificial Sequence
  gRNA target sequence
ccccgatgcatacaccacatgaa

SEQ ID NO: 1583 - DNA, 23 bp, Artificial Sequence
  gRNA target sequence
cccgatgcatacaccacatgaaa

SEQ ID NO: 1584 - DNA, 23 bp, Artificial Sequence
  gRNA target sequence
ccgatgcatacaccacatgaaac

SEQ ID NO: 1585 - DNA, 23 bp, Artificial Sequence
  gRNA target sequence
ccacatgaaacatcctatcatct

SEQ ID NO: 1586 - DNA, 23 bp, Artificial Sequence
  gRNA target sequence
cctatcatctgtaggctcattca

SEQ ID NO: 1587 - DNA, 23 bp, Artificial Sequence
  gRNA target sequence
ccttcgcttcgaagcgaaaagtc

SEQ ID NO: 1588 - DNA, 23 bp, Artificial Sequence
  gRNA target sequence
cctaatagtagaagaaccctcca

SEQ ID NO: 1589 - DNA, 23 bp, Artificial Sequence
  gRNA target sequence
ccctccataaacctggagtgact

SEQ ID NO: 1590 - DNA, 23 bp, Artificial Sequence
  gRNA target sequence
cctccataaacctggagtgacta

SEQ ID NO: 1591 - DNA, 23 bp, Artificial Sequence
  gRNA target sequence
ccataaacctggagtgactatat

SEQ ID NO: 1592 - DNA, 23 bp, Artificial Sequence
  gRNA target sequence
cctggagtgactatatggatgcc

SEQ ID NO: 1593 - DNA, 23 bp, Artificial Sequence
  gRNA target sequence
ccccccaccctaccacacattcg

SEQ ID NO: 1594 - DNA, 23 bp, Artificial Sequence
  gRNA target sequence
cccccaccctaccacacattcga

SEQ ID NO: 1595 - DNA, 23 bp, Artificial Sequence
  gRNA target sequence
ccccaccctaccacacattcgaa

SEQ ID NO: 1596 - DNA, 23 bp, Artificial Sequence
  gRNA target sequence
cccaccctaccacacattcgaag

SEQ ID NO: 1597 - DNA, 23 bp, Artificial Sequence
  gRNA target sequence
ccaccctaccacacattcgaaga

SEQ ID NO: 1598 - DNA, 23 bp, Artificial Sequence
  gRNA target sequence
ccctaccacacattcgaagaacc

SEQ ID NO: 1599 - DNA, 23 bp, Artificial Sequence
  gRNA target sequence
cctaccacacattcgaagaaccc

SEQ ID NO: 1600 - DNA, 23 bp, Artificial Sequence
  gRNA target sequence
ccacacattcgaagaacccgtat

SEQ ID NO: 1601 - DNA, 23 bp, Artificial Sequence
  gRNA target sequence
cccgtatacataaaatctagaca

SEQ ID NO: 1602 - DNA, 23 bp, Artificial Sequence
  gRNA target sequence
ccgtatacataaaatctagacaa

SEQ ID NO: 1603 - DNA, 23 bp, Artificial Sequence
  gRNA target sequence
ccccccaaagctggtttcaagcc

SEQ ID NO: 1604 - DNA, 23 bp, Artificial Sequence
  gRNA target sequence
cccccaaagctggtttcaagcca

SEQ ID NO: 1605 - DNA, 23 bp, Artificial Sequence
  gRNA target sequence
ccccaaagctggtttcaagccaa

SEQ ID NO: 1606 - DNA, 23 bp, Artificial Sequence
  gRNA target sequence
cccaaagctggtttcaagccaac

SEQ ID NO: 1607 - DNA, 23 bp, Artificial Sequence
  gRNA target sequence
ccaaagctggtttcaagccaacc

SEQ ID NO: 1608 - DNA, 23 bp, Artificial Sequence
  gRNA target sequence
ccaaccccatggcctccatgact

SEQ ID NO: 1609 - DNA, 23 bp, Artificial Sequence
  gRNA target sequence
ccccatggcctccatgacttttt

SEQ ID NO: 1610 - DNA, 23 bp, Artificial Sequence
  gRNA target sequence
cccatggcctccatgactttttc

SEQ ID NO: 1611 - DNA, 23 bp, Artificial Sequence
  gRNA target sequence
ccatggcctccatgactttttca

SEQ ID NO: 1612 - DNA, 23 bp, Artificial Sequence
  gRNA target sequence
cctccatgactttttcaaaaagg

SEQ ID NO: 1613 - DNA, 23 bp, Artificial Sequence
  gRNA target sequence
ccatgactttttcaaaaaggtat

SEQ ID NO: 1614 - DNA, 23 bp, Artificial Sequence
  gRNA target sequence
ccatttcataactttgtcaaagt

SEQ ID NO: 1615 - DNA, 23 bp, Artificial Sequence
  gRNA target sequence
cctatatatcttaatggcacatg

SEQ ID NO: 1616 - DNA, 23 bp, Artificial Sequence
  gRNA target sequence
cccctatcatagaagagcttatc

SEQ ID NO: 1617 - DNA, 23 bp, Artificial Sequence
  gRNA target sequence
ccctatcatagaagagcttatca

SEQ ID NO: 1618 - DNA, 23 bp, Artificial Sequence
  gRNA target sequence
cctatcatagaagagcttatcac

SEQ ID NO: 1619 - DNA, 23 bp, Artificial Sequence
  gRNA target sequence
cctttcatgatcacgccctcata

SEQ ID NO: 1620 - DNA, 23 bp, Artificial Sequence
  gRNA target sequence
ccctcataatcattttccttatc

SEQ ID NO: 1621 - DNA, 23 bp, Artificial Sequence
  gRNA target sequence
cctcataatcattttccttatct

SEQ ID NO: 1622 - DNA, 23 bp, Artificial Sequence
  gRNA target sequence
ccttatctgcttcctagtcctgt

SEQ ID NO: 1623 - DNA, 23 bp, Artificial Sequence
  gRNA target sequence
cctagtcctgtatgcccttttcc

SEQ ID NO: 1624 - DNA, 23 bp, Artificial Sequence
  gRNA target sequence
cctgtatgcccttttcctaacac

SEQ ID NO: 1625 - DNA, 23 bp, Artificial Sequence
  gRNA target sequence
cccttttcctaacactcacaaca

SEQ ID NO: 1626 - DNA, 23 bp, Artificial Sequence
  gRNA target sequence
ccttttcctaacactcacaacaa

SEQ ID NO: 1627 - DNA, 23 bp, Artificial Sequence
  gRNA target sequence
cctaacactcacaacaaaactaa

SEQ ID NO: 1628 - DNA, 23 bp, Artificial Sequence
  gRNA target sequence
ccgtctgaactatcctgcccgcc

SEQ ID NO: 1629 - DNA, 23 bp, Artificial Sequence
  gRNA target sequence
cctgcccgccatcatcctagtcc

SEQ ID NO: 1630 - DNA, 23 bp, Artificial Sequence
  gRNA target sequence
cccgccatcatcctagtcctcat

SEQ ID NO: 1631 - DNA, 23 bp, Artificial Sequence
  gRNA target sequence
ccgccatcatcctagtcctcatc

SEQ ID NO: 1632 - DNA, 23 bp, Artificial Sequence
  gRNA target sequence
ccatcatcctagtcctcatcgcc

SEQ ID NO: 1633 - DNA, 23 bp, Artificial Sequence
  gRNA target sequence
cctagtcctcatcgccctcccat

SEQ ID NO: 1634 - DNA, 23 bp, Artificial Sequence
  gRNA target sequence
cctcatcgccctcccatccctac

SEQ ID NO: 1635 - DNA, 23 bp, Artificial Sequence
  gRNA target sequence
ccctcccatccctacgcatcctt

SEQ ID NO: 1636 - DNA, 23 bp, Artificial Sequence
  gRNA target sequence
cctcccatccctacgcatccttt

SEQ ID NO: 1637 - DNA, 23 bp, Artificial Sequence
  gRNA target sequence
cccatccctacgcatcctttaca

SEQ ID NO: 1638 - DNA, 23 bp, Artificial Sequence
  gRNA target sequence
ccatccctacgcatcctttacat

SEQ ID NO: 1639 - DNA, 23 bp, Artificial Sequence
  gRNA target sequence
ccctacgcatcctttacataaca

SEQ ID NO: 1640 - DNA, 23 bp, Artificial Sequence
  gRNA target sequence
cctacgcatcctttacataacag

SEQ ID NO: 1641 - DNA, 23 bp, Artificial Sequence
  gRNA target sequence
cctttacataacagacgaggtca

SEQ ID NO: 1642 - DNA, 23 bp, Artificial Sequence
  gRNA target sequence
ccctcccttaccatcaaatcaat

SEQ ID NO: 1643 - DNA, 23 bp, Artificial Sequence
  gRNA target sequence
cctcccttaccatcaaatcaatt

SEQ ID NO: 1644 - DNA, 23 bp, Artificial Sequence
  gRNA target sequence
cccttaccatcaaatcaattggc

SEQ ID NO: 1645 - DNA, 23 bp, Artificial Sequence
  gRNA target sequence
ccttaccatcaaatcaattggcc

SEQ ID NO: 1646 - DNA, 23 bp, Artificial Sequence
  gRNA target sequence
ccatcaaatcaattggccaccaa

SEQ ID NO: 1647 - DNA, 23 bp, Artificial Sequence
  gRNA target sequence
ccaccaatggtactgaacctacg

SEQ ID NO: 1648 - DNA, 23 bp, Artificial Sequence
  gRNA target sequence
ccaatggtactgaacctacgagt

SEQ ID NO: 1649 - DNA, 23 bp, Artificial Sequence
  gRNA target sequence
cctacgagtacaccgactacggc

SEQ ID NO: 1650 - DNA, 23 bp, Artificial Sequence
  gRNA target sequence
ccgactacggcggactaatcttc

SEQ ID NO: 1651 - DNA, 23 bp, Artificial Sequence
  gRNA target sequence
cctacatacttcccccattattc

SEQ ID NO: 1652 - DNA, 23 bp, Artificial Sequence
  gRNA target sequence
cccccattattcctagaaccagg

SEQ ID NO: 1653 - DNA, 23 bp, Artificial Sequence
  gRNA target sequence
ccccattattcctagaaccaggc

SEQ ID NO: 1654 - DNA, 23 bp, Artificial Sequence
  gRNA target sequence
cccattattcctagaaccaggcg

SEQ ID NO: 1655 - DNA, 23 bp, Artificial Sequence
  gRNA target sequence
ccattattcctagaaccaggcga

SEQ ID NO: 1656 - DNA, 23 bp, Artificial Sequence
  gRNA target sequence
cctagaaccaggcgacctgcgac

SEQ ID NO: 1657 - DNA, 23 bp, Artificial Sequence
  gRNA target sequence
ccaggcgacctgcgactccttga

SEQ ID NO: 1658 - DNA, 23 bp, Artificial Sequence
  gRNA target sequence
cctgcgactccttgacgttgaca

SEQ ID NO: 1659 - DNA, 23 bp, Artificial Sequence
  gRNA target sequence
ccttgacgttgacaatcgagtag

SEQ ID NO: 1660 - DNA, 23 bp, Artificial Sequence
  gRNA target sequence
cccgattgaagcccccattcgta

SEQ ID NO: 1661 - DNA, 23 bp, Artificial Sequence
  gRNA target sequence
ccgattgaagcccccattcgtat

SEQ ID NO: 1662 - DNA, 23 bp, Artificial Sequence
  gRNA target sequence
cccccattcgtataataattaca

SEQ ID NO: 1663 - DNA, 23 bp, Artificial Sequence
  gRNA target sequence
ccccattcgtataataattacat

SEQ ID NO: 1664 - DNA, 23 bp, Artificial Sequence
  gRNA target sequence
cccattcgtataataattacatc

SEQ ID NO: 1665 - DNA, 23 bp, Artificial Sequence
  gRNA target sequence
ccattcgtataataattacatca

SEQ ID NO: 1666 - DNA, 23 bp, Artificial Sequence
  gRNA target sequence
ccccacattaggcttaaaaacag

SEQ ID NO: 1667 - DNA, 23 bp, Artificial Sequence
  gRNA target sequence
cccacattaggcttaaaaacaga

SEQ ID NO: 1668 - DNA, 23 bp, Artificial Sequence
  gRNA target sequence
ccacattaggcttaaaaacagat

SEQ ID NO: 1669 - DNA, 23 bp, Artificial Sequence
  gRNA target sequence
cccggacgtctaaaccaaaccac

SEQ ID NO: 1670 - DNA, 23 bp, Artificial Sequence
  gRNA target sequence
ccggacgtctaaaccaaaccact

SEQ ID NO: 1671 - DNA, 23 bp, Artificial Sequence
  gRNA target sequence
ccaaaccactttcaccgctacac

SEQ ID NO: 1672 - DNA, 23 bp, Artificial Sequence
  gRNA target sequence
ccactttcaccgctacacgaccg

SEQ ID NO: 1673 - DNA, 23 bp, Artificial Sequence
  gRNA target sequence
ccgctacacgaccgggggtatac

SEQ ID NO: 1674 - DNA, 23 bp, Artificial Sequence
  gRNA target sequence
ccgggggtatactacggtcaatg

SEQ ID NO: 1675 - DNA, 23 bp, Artificial Sequence
  gRNA target sequence
ccacagtttcatgcccatcgtcc

SEQ ID NO: 1676 - DNA, 23 bp, Artificial Sequence
  gRNA target sequence
cccatcgtcctagaattaattcc

SEQ ID NO: 1677 - DNA, 23 bp, Artificial Sequence
  gRNA target sequence
ccatcgtcctagaattaattccc

SEQ ID NO: 1678 - DNA, 23 bp, Artificial Sequence
  gRNA target sequence
cctagaattaattcccctaaaaa

SEQ ID NO: 1679 - DNA, 23 bp, Artificial Sequence
  gRNA target sequence
cccctaaaaatctttgaaatagg

SEQ ID NO: 1680 - DNA, 23 bp, Artificial Sequence
  gRNA target sequence
ccctaaaaatctttgaaataggg

SEQ ID NO: 1681 - DNA, 23 bp, Artificial Sequence
  gRNA target sequence
cctaaaaatctttgaaatagggc

SEQ ID NO: 1682 - DNA, 23 bp, Artificial Sequence
  gRNA target sequence
cccgtatttaccctatagcaccc

SEQ ID NO: 1683 - DNA, 23 bp, Artificial Sequence
  gRNA target sequence
ccgtatttaccctatagcacccc

SEQ ID NO: 1684 - DNA, 23 bp, Artificial Sequence
  gRNA target sequence
ccctatagcaccccctctacccc

SEQ ID NO: 1685 - DNA, 23 bp, Artificial Sequence
  gRNA target sequence
cctatagcaccccctctaccccc

SEQ ID NO: 1686 - DNA, 23 bp, Artificial Sequence
  gRNA target sequence
ccccctctaccccctctagagcc

SEQ ID NO: 1687 - DNA, 23 bp, Artificial Sequence
  gRNA target sequence
cccctctaccccctctagagccc

SEQ ID NO: 1688 - DNA, 23 bp, Artificial Sequence
  gRNA target sequence
ccctctaccccctctagagccca

SEQ ID NO: 1689 - DNA, 23 bp, Artificial Sequence
  gRNA target sequence
cctctaccccctctagagcccac

SEQ ID NO: 1690 - DNA, 23 bp, Artificial Sequence
  gRNA target sequence
ccccctctagagcccactgtaaa

SEQ ID NO: 1691 - DNA, 23 bp, Artificial Sequence
  gRNA target sequence
cccctctagagcccactgtaaag

SEQ ID NO: 1692 - DNA, 23 bp, Artificial Sequence
  gRNA target sequence
ccctctagagcccactgtaaagc

SEQ ID NO: 1693 - DNA, 23 bp, Artificial Sequence
  gRNA target sequence
cctctagagcccactgtaaagct

SEQ ID NO: 1694 - DNA, 23 bp, Artificial Sequence
  gRNA target sequence
cccactgtaaagctaacttagca

SEQ ID NO: 1695 - DNA, 23 bp, Artificial Sequence
  gRNA target sequence
ccactgtaaagctaacttagcat

SEQ ID NO: 1696 - DNA, 23 bp, Artificial Sequence
  gRNA target sequence
ccttttaagttaaagattaagag

SEQ ID NO: 1697 - DNA, 23 bp, Artificial Sequence
  gRNA target sequence
ccaacacctctttacagtgaaat

SEQ ID NO: 1698 - DNA, 23 bp, Artificial Sequence
  gRNA target sequence
cctctttacagtgaaatgcccca

SEQ ID NO: 1699 - DNA, 23 bp, Artificial Sequence
  gRNA target sequence
ccccaactaaatactaccgtatg

SEQ ID NO: 1700 - DNA, 23 bp, Artificial Sequence
  gRNA target sequence
cccaactaaatactaccgtatgg

SEQ ID NO: 1701 - DNA, 23 bp, Artificial Sequence
  gRNA target sequence
ccaactaaatactaccgtatggc

SEQ ID NO: 1702 - DNA, 23 bp, Artificial Sequence
  gRNA target sequence
ccgtatggcccaccataattacc

SEQ ID NO: 1703 - DNA, 23 bp, Artificial Sequence
  gRNA target sequence
cccaccataattacccccatact

SEQ ID NO: 1704 - DNA, 23 bp, Artificial Sequence
  gRNA target sequence
ccaccataattacccccatactc

SEQ ID NO: 1705 - DNA, 23 bp, Artificial Sequence
  gRNA target sequence
ccataattacccccatactcctt

SEQ ID NO: 1706 - DNA, 23 bp, Artificial Sequence
  gRNA target sequence
cccccatactccttacactattc

SEQ ID NO: 1707 - DNA, 23 bp, Artificial Sequence
  gRNA target sequence
ccccatactccttacactattcc

SEQ ID NO: 1708 - DNA, 23 bp, Artificial Sequence
  gRNA target sequence
cccatactccttacactattcct

SEQ ID NO: 1709 - DNA, 23 bp, Artificial Sequence
  gRNA target sequence
ccatactccttacactattcctc

SEQ ID NO: 1710 - DNA, 23 bp, Artificial Sequence
  gRNA target sequence
ccttacactattcctcatcaccc

SEQ ID NO: 1711 - DNA, 23 bp, Artificial Sequence
  gRNA target sequence
cctcatcacccaactaaaaatat

SEQ ID NO: 1712 - DNA, 23 bp, Artificial Sequence
  gRNA target sequence
cccaactaaaaatattaaacaca

SEQ ID NO: 1713 - DNA, 23 bp, Artificial Sequence
  gRNA target sequence
ccaactaaaaatattaaacacaa

SEQ ID NO: 1714 - DNA, 23 bp, Artificial Sequence
  gRNA target sequence
ccacctacctccctcaccaaagc

SEQ ID NO: 1715 - DNA, 23 bp, Artificial Sequence
  gRNA target sequence
cctacctccctcaccaaagccca

SEQ ID NO: 1716 - DNA, 23 bp, Artificial Sequence
  gRNA target sequence
cctccctcaccaaagcccataaa

SEQ ID NO: 1717 - DNA, 23 bp, Artificial Sequence
  gRNA target sequence
ccctcaccaaagcccataaaaat

SEQ ID NO: 1718 - DNA, 23 bp, Artificial Sequence
  gRNA target sequence
cctcaccaaagcccataaaaata

SEQ ID NO: 1719 - DNA, 23 bp, Artificial Sequence
  gRNA target sequence
ccaaagcccataaaaataaaaaa

SEQ ID NO: 1720 - DNA, 23 bp, Artificial Sequence
  gRNA target sequence
cccataaaaataaaaaattataa

SEQ ID NO: 1721 - DNA, 23 bp, Artificial Sequence
  gRNA target sequence
ccataaaaataaaaaattataac

SEQ ID NO: 1722 - DNA, 23 bp, Artificial Sequence
  gRNA target sequence
ccctgagaaccaaaatgaacgaa

SEQ ID NO: 1723 - DNA, 23 bp, Artificial Sequence
  gRNA target sequence
cctgagaaccaaaatgaacgaaa

SEQ ID NO: 1724 - DNA, 23 bp, Artificial Sequence
  gRNA target sequence
ccaaaatgaacgaaaatctgttc

SEQ ID NO: 1725 - DNA, 23 bp, Artificial Sequence
  gRNA target sequence
cccccacaatcctaggcctaccc

SEQ ID NO: 1726 - DNA, 23 bp, Artificial Sequence
  gRNA target sequence
ccccacaatcctaggcctacccg

SEQ ID NO: 1727 - DNA, 23 bp, Artificial Sequence
  gRNA target sequence
cccacaatcctaggcctacccgc

SEQ ID NO: 1728 - DNA, 23 bp, Artificial Sequence
  gRNA target sequence
ccacaatcctaggcctacccgcc

SEQ ID NO: 1729 - DNA, 23 bp, Artificial Sequence
  gRNA target sequence
cctaggcctacccgccgcagtac

SEQ ID NO: 1730 - DNA, 23 bp, Artificial Sequence
  gRNA target sequence
cctacccgccgcagtactgatca

SEQ ID NO: 1731 - DNA, 23 bp, Artificial Sequence
  gRNA target sequence
cccgccgcagtactgatcattct

SEQ ID NO: 1732 - DNA, 23 bp, Artificial Sequence
  gRNA target sequence
ccgccgcagtactgatcattcta

SEQ ID NO: 1733 - DNA, 23 bp, Artificial Sequence
  gRNA target sequence
ccgcagtactgatcattctattt

SEQ ID NO: 1734 - DNA, 23 bp, Artificial Sequence
  gRNA target sequence
ccccctctattgatccccacctc

SEQ ID NO: 1735 - DNA, 23 bp, Artificial Sequence
  gRNA target sequence
cccctctattgatccccacctcc

SEQ ID NO: 1736 - DNA, 23 bp, Artificial Sequence
  gRNA target sequence
ccctctattgatccccacctcca

SEQ ID NO: 1737 - DNA, 23 bp, Artificial Sequence
  gRNA target sequence
cctctattgatccccacctccaa

SEQ ID NO: 1738 - DNA, 23 bp, Artificial Sequence
  gRNA target sequence
ccccacctccaaatatctcatca

SEQ ID NO: 1739 - DNA, 23 bp, Artificial Sequence
  gRNA target sequence
cccacctccaaatatctcatcaa

SEQ ID NO: 1740 - DNA, 23 bp, Artificial Sequence
  gRNA target sequence
ccacctccaaatatctcatcaac

SEQ ID NO: 1741 - DNA, 23 bp, Artificial Sequence
  gRNA target sequence
cctccaaatatctcatcaacaac

SEQ ID NO: 1742 - DNA, 23 bp, Artificial Sequence
  gRNA target sequence
ccaaatatctcatcaacaaccga

SEQ ID NO: 1743 - DNA, 23 bp, Artificial Sequence
  gRNA target sequence
ccgactaatcaccacccaacaat

SEQ ID NO: 1744 - DNA, 23 bp, Artificial Sequence
  gRNA target sequence
ccacccaacaatgactaatcaaa

SEQ ID NO: 1745 - DNA, 23 bp, Artificial Sequence
  gRNA target sequence
cccaacaatgactaatcaaacta

SEQ ID NO: 1746 - DNA, 23 bp, Artificial Sequence
  gRNA target sequence
ccaacaatgactaatcaaactaa

SEQ ID NO: 1747 - DNA, 23 bp, Artificial Sequence
  gRNA target sequence
cctcaaaacaaatgataaccata

SEQ ID NO: 1748 - DNA, 23 bp, Artificial Sequence
  gRNA target sequence
ccatacacaacactaaaggacga

SEQ ID NO: 1749 - DNA, 23 bp, Artificial Sequence
  gRNA target sequence
cctgatctcttatactagtatcc

SEQ ID NO: 1750 - DNA, 23 bp, Artificial Sequence
  gRNA target sequence
ccttaatcatttttattgccaca

SEQ ID NO: 1751 - DNA, 23 bp, Artificial Sequence
  gRNA target sequence
ccacaactaacctcctcggactc

SEQ ID NO: 1752 - DNA, 23 bp, Artificial Sequence
  gRNA target sequence
cctcctcggactcctgcctcact

SEQ ID NO: 1753 - DNA, 23 bp, Artificial Sequence
  gRNA target sequence
cctcggactcctgcctcactcat

SEQ ID NO: 1754 - DNA, 23 bp, Artificial Sequence
  gRNA target sequence
cctgcctcactcatttacaccaa

SEQ ID NO: 1755 - DNA, 23 bp, Artificial Sequence
  gRNA target sequence
cctcactcatttacaccaaccac

SEQ ID NO: 1756 - DNA, 23 bp, Artificial Sequence
  gRNA target sequence
ccaaccacccaactatctataaa

SEQ ID NO: 1757 - DNA, 23 bp, Artificial Sequence
  gRNA target sequence
ccacccaactatctataaaccta

SEQ ID NO: 1758 - DNA, 23 bp, Artificial Sequence
  gRNA target sequence
cccaactatctataaacctagcc

SEQ ID NO: 1759 - DNA, 23 bp, Artificial Sequence
  gRNA target sequence
ccaactatctataaacctagcca

SEQ ID NO: 1760 - DNA, 23 bp, Artificial Sequence
  gRNA target sequence
cctagccatggccatccccttat

SEQ ID NO: 1761 - DNA, 23 bp, Artificial Sequence
  gRNA target sequence
ccatggccatccccttatgagcg

SEQ ID NO: 1762 - DNA, 23 bp, Artificial Sequence
  gRNA target sequence
ccatccccttatgagcgggcaca

SEQ ID NO: 1763 - DNA, 23 bp, Artificial Sequence
  gRNA target sequence
ccccttatgagcgggcacagtga

SEQ ID NO: 1764 - DNA, 23 bp, Artificial Sequence
  gRNA target sequence
cccttatgagcgggcacagtgat

SEQ ID NO: 1765 - DNA, 23 bp, Artificial Sequence
  gRNA target sequence
ccttatgagcgggcacagtgatt

SEQ ID NO: 1766 - DNA, 23 bp, Artificial Sequence
  gRNA target sequence
ccctagcccacttcttaccacaa

SEQ ID NO: 1767 - DNA, 23 bp, Artificial Sequence
  gRNA target sequence
cctagcccacttcttaccacaag

SEQ ID NO: 1768 - DNA, 23 bp, Artificial Sequence
  gRNA target sequence
cccacttcttaccacaaggcaca

SEQ ID NO: 1769 - DNA, 23 bp, Artificial Sequence
  gRNA target sequence
ccacttcttaccacaaggcacac

SEQ ID NO: 1770 - DNA, 23 bp, Artificial Sequence
  gRNA target sequence
ccacaaggcacacctacacccct

SEQ ID NO: 1771 - DNA, 23 bp, Artificial Sequence
  gRNA target sequence
cctacaccccttatccccatact

SEQ ID NO: 1772 - DNA, 23 bp, Artificial Sequence
  gRNA target sequence
ccccttatccccatactagttat

SEQ ID NO: 1773 - DNA, 23 bp, Artificial Sequence
  gRNA target sequence
cccttatccccatactagttatt

SEQ ID NO: 1774 - DNA, 23 bp, Artificial Sequence
  gRNA target sequence
ccttatccccatactagttatta

SEQ ID NO: 1775 - DNA, 23 bp, Artificial Sequence
  gRNA target sequence
ccccatactagttattatcgaaa

SEQ ID NO: 1776 - DNA, 23 bp, Artificial Sequence
  gRNA target sequence
cccatactagttattatcgaaac

SEQ ID NO: 1777 - DNA, 23 bp, Artificial Sequence
  gRNA target sequence
ccatactagttattatcgaaacc

SEQ ID NO: 1778 - DNA, 23 bp, Artificial Sequence
  gRNA target sequence
ccatcagcctactcattcaacca

SEQ ID NO: 1779 - DNA, 23 bp, Artificial Sequence
  gRNA target sequence
cctactcattcaaccaatagccc

SEQ ID NO: 1780 - DNA, 23 bp, Artificial Sequence
  gRNA target sequence
ccaatagccctggccgtacgcct

SEQ ID NO: 1781 - DNA, 23 bp, Artificial Sequence
  gRNA target sequence
ccctggccgtacgcctaaccgct

SEQ ID NO: 1782 - DNA, 23 bp, Artificial Sequence
  gRNA target sequence
cctggccgtacgcctaaccgcta

SEQ ID NO: 1783 - DNA, 23 bp, Artificial Sequence
  gRNA target sequence
ccgtacgcctaaccgctaacatt

SEQ ID NO: 1784 - DNA, 23 bp, Artificial Sequence
  gRNA target sequence
cctaaccgctaacattactgcag

SEQ ID NO: 1785 - DNA, 23 bp, Artificial Sequence
  gRNA target sequence
ccgctaacattactgcaggccac

SEQ ID NO: 1786 - DNA, 23 bp, Artificial Sequence
  gRNA target sequence
ccacctactcatgcacctaattg

SEQ ID NO: 1787 - DNA, 23 bp, Artificial Sequence
  gRNA target sequence
cctactcatgcacctaattggaa

SEQ ID NO: 1788 - DNA, 23 bp, Artificial Sequence
  gRNA target sequence
cctaattggaagcgccaccctag

SEQ ID NO: 1789 - DNA, 23 bp, Artificial Sequence
  gRNA target sequence
ccaccctagcaatatcaaccatt

SEQ ID NO: 1790 - DNA, 23 bp, Artificial Sequence
  gRNA target sequence
ccctagcaatatcaaccattaac

SEQ ID NO: 1791 - DNA, 23 bp, Artificial Sequence
  gRNA target sequence
cctagcaatatcaaccattaacc

SEQ ID NO: 1792 - DNA, 23 bp, Artificial Sequence
  gRNA target sequence
ccattaaccttccctctacactt

SEQ ID NO: 1793 - DNA, 23 bp, Artificial Sequence
  gRNA target sequence
ccttccctctacacttatcatct

SEQ ID NO: 1794 - DNA, 23 bp, Artificial Sequence
  gRNA target sequence
ccctctacacttatcatcttcac

SEQ ID NO: 1795 - DNA, 23 bp, Artificial Sequence
  gRNA target sequence
cctctacacttatcatcttcaca

SEQ ID NO: 1796 - DNA, 23 bp, Artificial Sequence
  gRNA target sequence
cctagaaatcgctgtcgccttaa

SEQ ID NO: 1797 - DNA, 23 bp, Artificial Sequence
  gRNA target sequence
ccttaatccaagcctacgttttc

SEQ ID NO: 1798 - DNA, 23 bp, Artificial Sequence
  gRNA target sequence
ccaagcctacgttttcacacttc

SEQ ID NO: 1799 - DNA, 23 bp, Artificial Sequence
  gRNA target sequence
cctacgttttcacacttctagta

SEQ ID NO: 1800 - DNA, 23 bp, Artificial Sequence
  gRNA target sequence
cctctacctgcacgacaacacat

SEQ ID NO: 1801 - DNA, 23 bp, Artificial Sequence
  gRNA target sequence
cctgcacgacaacacataatgac

SEQ ID NO: 1802 - DNA, 23 bp, Artificial Sequence
  gRNA target sequence
cccaccaatcacatgcctatcat

SEQ ID NO: 1803 - DNA, 23 bp, Artificial Sequence
  gRNA target sequence
ccaccaatcacatgcctatcata

SEQ ID NO: 1804 - DNA, 23 bp, Artificial Sequence
  gRNA target sequence
ccaatcacatgcctatcatatag

SEQ ID NO: 1805 - DNA, 23 bp, Artificial Sequence
  gRNA target sequence
cctatcatatagtaaaacccagc

SEQ ID NO: 1806 - DNA, 23 bp, Artificial Sequence
  gRNA target sequence
cccagcccatgacccctaacagg

SEQ ID NO: 1807 - DNA, 23 bp, Artificial Sequence
  gRNA target sequence
ccagcccatgacccctaacaggg

SEQ ID NO: 1808 - DNA, 23 bp, Artificial Sequence
  gRNA target sequence
cccatgacccctaacaggggccc

SEQ ID NO: 1809 - DNA, 23 bp, Artificial Sequence
  gRNA target sequence
ccatgacccctaacaggggccct

SEQ ID NO: 1810 - DNA, 23 bp, Artificial Sequence
  gRNA target sequence
cccctaacaggggccctctcagc

SEQ ID NO: 1811 - DNA, 23 bp, Artificial Sequence
  gRNA target sequence
ccctaacaggggccctctcagcc

SEQ ID NO: 1812 - DNA, 23 bp, Artificial Sequence
  gRNA target sequence
cctaacaggggccctctcagccc

SEQ ID NO: 1813 - DNA, 23 bp, Artificial Sequence
  gRNA target sequence
ccctctcagccctcctaatgacc

SEQ ID NO: 1814 - DNA, 23 bp, Artificial Sequence
  gRNA target sequence
cctctcagccctcctaatgacct

SEQ ID NO: 1815 - DNA, 23 bp, Artificial Sequence
  gRNA target sequence
ccctcctaatgacctccggccta

SEQ ID NO: 1816 - DNA, 23 bp, Artificial Sequence
  gRNA target sequence
cctcctaatgacctccggcctag

SEQ ID NO: 1817 - DNA, 23 bp, Artificial Sequence
  gRNA target sequence
cctaatgacctccggcctagcca

SEQ ID NO: 1818 - DNA, 23 bp, Artificial Sequence
  gRNA target sequence
cctccggcctagccatgtgattt

SEQ ID NO: 1819 - DNA, 23 bp, Artificial Sequence
  gRNA target sequence
ccggcctagccatgtgatttcac

SEQ ID NO: 1820 - DNA, 23 bp, Artificial Sequence
  gRNA target sequence
cctagccatgtgatttcacttcc

SEQ ID NO: 1821 - DNA, 23 bp, Artificial Sequence
  gRNA target sequence
ccatgtgatttcacttccactcc

SEQ ID NO: 1822 - DNA, 23 bp, Artificial Sequence
  gRNA target sequence
ccactccataacgctcctcatac

SEQ ID NO: 1823 - DNA, 23 bp, Artificial Sequence
  gRNA target sequence
ccataacgctcctcatactaggc

SEQ ID NO: 1824 - DNA, 23 bp, Artificial Sequence
  gRNA target sequence
cctcatactaggcctactaacca

SEQ ID NO: 1825 - DNA, 23 bp, Artificial Sequence
  gRNA target sequence
cctactaaccaacacactaacca

SEQ ID NO: 1826 - DNA, 23 bp, Artificial Sequence
  gRNA target sequence
ccaacacactaaccatataccaa

SEQ ID NO: 1827 - DNA, 23 bp, Artificial Sequence
  gRNA target sequence
ccatataccaatgatggcgcgat

SEQ ID NO: 1828 - DNA, 23 bp, Artificial Sequence
  gRNA target sequence
ccaatgatggcgcgatgtaacac

SEQ ID NO: 1829 - DNA, 23 bp, Artificial Sequence
  gRNA target sequence
ccaaggccaccacacaccacctg

SEQ ID NO: 1830 - DNA, 23 bp, Artificial Sequence
  gRNA target sequence
ccaccacacaccacctgtccaaa

SEQ ID NO: 1831 - DNA, 23 bp, Artificial Sequence
  gRNA target sequence
ccacacaccacctgtccaaaaag

SEQ ID NO: 1832 - DNA, 23 bp, Artificial Sequence
  gRNA target sequence
ccacctgtccaaaaaggccttcg

SEQ ID NO: 1833 - DNA, 23 bp, Artificial Sequence
  gRNA target sequence
cctgtccaaaaaggccttcgata

SEQ ID NO: 1834 - DNA, 23 bp, Artificial Sequence
  gRNA target sequence
ccaaaaaggccttcgatacggga

SEQ ID NO: 1835 - DNA, 23 bp, Artificial Sequence
  gRNA target sequence
ccttcgatacgggataatcctat

SEQ ID NO: 1836 - DNA, 23 bp, Artificial Sequence
  gRNA target sequence
cctatttattacctcagaagttt

SEQ ID NO: 1837 - DNA, 23 bp, Artificial Sequence
  gRNA target sequence
cctcagaagtttttttcttcgca

SEQ ID NO: 1838 - DNA, 23 bp, Artificial Sequence
  gRNA target sequence
ccttttaccactccagcctagcc

SEQ ID NO: 1839 - DNA, 23 bp, Artificial Sequence
  gRNA target sequence
ccactccagcctagcccctaccc

SEQ ID NO: 1840 - DNA, 23 bp, Artificial Sequence
  gRNA target sequence
ccagcctagcccctaccccccaa

SEQ ID NO: 1841 - DNA, 23 bp, Artificial Sequence
  gRNA target sequence
cctagcccctaccccccaattag

SEQ ID NO: 1842 - DNA, 23 bp, Artificial Sequence
  gRNA target sequence
cccctaccccccaattaggaggg

SEQ ID NO: 1843 - DNA, 23 bp, Artificial Sequence
  gRNA target sequence
ccctaccccccaattaggagggc

SEQ ID NO: 1844 - DNA, 23 bp, Artificial Sequence
  gRNA target sequence
cctaccccccaattaggagggca

SEQ ID NO: 1845 - DNA, 23 bp, Artificial Sequence
  gRNA target sequence
ccccccaattaggagggcactgg

SEQ ID NO: 1846 - DNA, 23 bp, Artificial Sequence
  gRNA target sequence
cccccaattaggagggcactggc

SEQ ID NO: 1847 - DNA, 23 bp, Artificial Sequence
  gRNA target sequence
ccccaattaggagggcactggcc

SEQ ID NO: 1848 - DNA, 23 bp, Artificial Sequence
  gRNA target sequence
cccaattaggagggcactggccc

SEQ ID NO: 1849 - DNA, 23 bp, Artificial Sequence
  gRNA target sequence
ccaattaggagggcactggcccc

SEQ ID NO: 1850 - DNA, 23 bp, Artificial Sequence
  gRNA target sequence
cccccaacaggcatcaccccgct

SEQ ID NO: 1851 - DNA, 23 bp, Artificial Sequence
  gRNA target sequence
ccccaacaggcatcaccccgcta

SEQ ID NO: 1852 - DNA, 23 bp, Artificial Sequence
  gRNA target sequence
cccaacaggcatcaccccgctaa

SEQ ID NO: 1853 - DNA, 23 bp, Artificial Sequence
  gRNA target sequence
ccaacaggcatcaccccgctaaa

SEQ ID NO: 1854 - DNA, 23 bp, Artificial Sequence
  gRNA target sequence
ccccgctaaatcccctagaagtc

SEQ ID NO: 1855 - DNA, 23 bp, Artificial Sequence
  gRNA target sequence
cccgctaaatcccctagaagtcc

SEQ ID NO: 1856 - DNA, 23 bp, Artificial Sequence
  gRNA target sequence
ccgctaaatcccctagaagtccc

SEQ ID NO: 1857 - DNA, 23 bp, Artificial Sequence
  gRNA target sequence
cccctagaagtcccactcctaaa

SEQ ID NO: 1858 - DNA, 23 bp, Artificial Sequence
  gRNA target sequence
ccctagaagtcccactcctaaac

SEQ ID NO: 1859 - DNA, 23 bp, Artificial Sequence
  gRNA target sequence
cctagaagtcccactcctaaaca

SEQ ID NO: 1860 - DNA, 23 bp, Artificial Sequence
  gRNA target sequence
cccactcctaaacacatccgtat

SEQ ID NO: 1861 - DNA, 23 bp, Artificial Sequence
  gRNA target sequence
ccactcctaaacacatccgtatt

SEQ ID NO: 1862 - DNA, 23 bp, Artificial Sequence
  gRNA target sequence
cctaaacacatccgtattactcg

SEQ ID NO: 1863 - DNA, 23 bp, Artificial Sequence
  gRNA target sequence
ccgtattactcgcatcaggagta

SEQ ID NO: 1864 - DNA, 23 bp, Artificial Sequence
  gRNA target sequence
cctgagctcaccatagtctaata

SEQ ID NO: 1865 - DNA, 23 bp, Artificial Sequence
  gRNA target sequence
ccatagtctaatagaaaacaacc

SEQ ID NO: 1866 - DNA, 23 bp, Artificial Sequence
  gRNA target sequence
ccgaaaccaaataattcaagcac

SEQ ID NO: 1867 - DNA, 23 bp, Artificial Sequence
  gRNA target sequence
ccaaataattcaagcactgctta

SEQ ID NO: 1868 - DNA, 23 bp, Artificial Sequence
  gRNA target sequence
ccctcctacaagcctcagagtac

SEQ ID NO: 1869 - DNA, 23 bp, Artificial Sequence
  gRNA target sequence
cctcctacaagcctcagagtact

SEQ ID NO: 1870 - DNA, 23 bp, Artificial Sequence
  gRNA target sequence
cctacaagcctcagagtacttcg

SEQ ID NO: 1871 - DNA, 23 bp, Artificial Sequence
  gRNA target sequence
cctcagagtacttcgagtctccc

SEQ ID NO: 1872 - DNA, 23 bp, Artificial Sequence
  gRNA target sequence
cccttcaccatttccgacggcat

SEQ ID NO: 1873 - DNA, 23 bp, Artificial Sequence
  gRNA target sequence
ccttcaccatttccgacggcatc

SEQ ID NO: 1874 - DNA, 23 bp, Artificial Sequence
  gRNA target sequence
ccatttccgacggcatctacggc

SEQ ID NO: 1875 - DNA, 23 bp, Artificial Sequence
  gRNA target sequence
ccgacggcatctacggctcaaca

SEQ ID NO: 1876 - DNA, 23 bp, Artificial Sequence
  gRNA target sequence
ccacaggcttccacggacttcac

SEQ ID NO: 1877 - DNA, 23 bp, Artificial Sequence
  gRNA target sequence
ccacggacttcacgtcattattg

SEQ ID NO: 1878 - DNA, 23 bp, Artificial Sequence
  gRNA target sequence
cctcactatctgcttcatccgcc

SEQ ID NO: 1879 - DNA, 23 bp, Artificial Sequence
  gRNA target sequence
ccgccaactaatatttcacttta

SEQ ID NO: 1880 - DNA, 23 bp, Artificial Sequence
  gRNA target sequence
ccaactaatatttcactttacat

SEQ ID NO: 1881 - DNA, 23 bp, Artificial Sequence
  gRNA target sequence
ccaaacatcactttggcttcgaa

SEQ ID NO: 1882 - DNA, 23 bp, Artificial Sequence
  gRNA target sequence
ccgccgcctgatactggcatttt

SEQ ID NO: 1883 - DNA, 23 bp, Artificial Sequence
  gRNA target sequence
ccgcctgatactggcattttgta

SEQ ID NO: 1884 - DNA, 23 bp, Artificial Sequence
  gRNA target sequence
cctgatactggcattttgtagat

SEQ ID NO: 1885 - DNA, 23 bp, Artificial Sequence
  gRNA target sequence
ccatctattgatgagggtcttac

SEQ ID NO: 1886 - DNA, 23 bp, Artificial Sequence
  gRNA target sequence
ccgttaacttccaattaactagt

SEQ ID NO: 1887 - DNA, 23 bp, Artificial Sequence
  gRNA target sequence
ccaattaactagttttgacaaca

SEQ ID NO: 1888 - DNA, 23 bp, Artificial Sequence
  gRNA target sequence
ccttaattttaataatcaacacc

SEQ ID NO: 1889 - DNA, 23 bp, Artificial Sequence
  gRNA target sequence
ccctcctagccttactactaata

SEQ ID NO: 1890 - DNA, 23 bp, Artificial Sequence
  gRNA target sequence
cctcctagccttactactaataa

SEQ ID NO: 1891 - DNA, 23 bp, Artificial Sequence
  gRNA target sequence
cctagccttactactaataatta

SEQ ID NO: 1892 - DNA, 23 bp, Artificial Sequence
  gRNA target sequence
ccttactactaataattattaca

SEQ ID NO: 1893 - DNA, 23 bp, Artificial Sequence
  gRNA target sequence
ccacaactcaacggctacataga

SEQ ID NO: 1894 - DNA, 23 bp, Artificial Sequence
  gRNA target sequence
ccaccccttacgagtgcggcttc

SEQ ID NO: 1895 - DNA, 23 bp, Artificial Sequence
  gRNA target sequence
ccccttacgagtgcggcttcgac

SEQ ID NO: 1896 - DNA, 23 bp, Artificial Sequence
  gRNA target sequence
cccttacgagtgcggcttcgacc

SEQ ID NO: 1897 - DNA, 23 bp, Artificial Sequence
  gRNA target sequence
ccttacgagtgcggcttcgaccc

SEQ ID NO: 1898 - DNA, 23 bp, Artificial Sequence
  gRNA target sequence
ccctatatcccccgcccgcgtcc

SEQ ID NO: 1899 - DNA, 23 bp, Artificial Sequence
  gRNA target sequence
cctatatcccccgcccgcgtccc

SEQ ID NO: 1900 - DNA, 23 bp, Artificial Sequence
  gRNA target sequence
cccccgcccgcgtccctttctcc

SEQ ID NO: 1901 - DNA, 23 bp, Artificial Sequence
  gRNA target sequence
ccccgcccgcgtccctttctcca

SEQ ID NO: 1902 - DNA, 23 bp, Artificial Sequence
  gRNA target sequence
cccgcccgcgtccctttctccat

SEQ ID NO: 1903 - DNA, 23 bp, Artificial Sequence
  gRNA target sequence
ccgcccgcgtccctttctccata

SEQ ID NO: 1904 - DNA, 23 bp, Artificial Sequence
  gRNA target sequence
cccgcgtccctttctccataaaa

SEQ ID NO: 1905 - DNA, 23 bp, Artificial Sequence
  gRNA target sequence
ccgcgtccctttctccataaaat

SEQ ID NO: 1906 - DNA, 23 bp, Artificial Sequence
  gRNA target sequence
ccctttctccataaaattcttct

SEQ ID NO: 1907 - DNA, 23 bp, Artificial Sequence
  gRNA target sequence
cctttctccataaaattcttctt

SEQ ID NO: 1908 - DNA, 23 bp, Artificial Sequence
  gRNA target sequence
ccataaaattcttcttagtagct

SEQ ID NO: 1909 - DNA, 23 bp, Artificial Sequence
  gRNA target sequence
ccttcttattatttgatctagaa

SEQ ID NO: 1910 - DNA, 23 bp, Artificial Sequence
  gRNA target sequence
ccctccttttacccctaccatga

SEQ ID NO: 1911 - DNA, 23 bp, Artificial Sequence
  gRNA target sequence
cctccttttacccctaccatgag

SEQ ID NO: 1912 - DNA, 23 bp, Artificial Sequence
  gRNA target sequence
ccttttacccctaccatgagccc

SEQ ID NO: 1913 - DNA, 23 bp, Artificial Sequence
  gRNA target sequence
cccctaccatgagccctacaaac

SEQ ID NO: 1914 - DNA, 23 bp, Artificial Sequence
  gRNA target sequence
ccctaccatgagccctacaaaca

SEQ ID NO: 1915 - DNA, 23 bp, Artificial Sequence
  gRNA target sequence
cctaccatgagccctacaaacaa

SEQ ID NO: 1916 - DNA, 23 bp, Artificial Sequence
  gRNA target sequence
ccatgagccctacaaacaactaa

SEQ ID NO: 1917 - DNA, 23 bp, Artificial Sequence
  gRNA target sequence
ccctacaaacaactaacctgcca

SEQ ID NO: 1918 - DNA, 23 bp, Artificial Sequence
  gRNA target sequence
cctacaaacaactaacctgccac

SEQ ID NO: 1919 - DNA, 23 bp, Artificial Sequence
  gRNA target sequence
cctgccactaatagttatgtcat

SEQ ID NO: 1920 - DNA, 23 bp, Artificial Sequence
  gRNA target sequence
ccactaatagttatgtcatccct

SEQ ID NO: 1921 - DNA, 23 bp, Artificial Sequence
  gRNA target sequence
ccctcttattaatcatcatccta

SEQ ID NO: 1922 - DNA, 23 bp, Artificial Sequence
  gRNA target sequence
cctcttattaatcatcatcctag

SEQ ID NO: 1923 - DNA, 23 bp, Artificial Sequence
  gRNA target sequence
cctagccctaagtctggcctatg

SEQ ID NO: 1924 - DNA, 23 bp, Artificial Sequence
  gRNA target sequence
ccctaagtctggcctatgagtga

SEQ ID NO: 1925 - DNA, 23 bp, Artificial Sequence
  gRNA target sequence
cctaagtctggcctatgagtgac

SEQ ID NO: 1926 - DNA, 23 bp, Artificial Sequence
  gRNA target sequence
cctatgagtgactacaaaaagga

SEQ ID NO: 1927 - DNA, 23 bp, Artificial Sequence
  gRNA target sequence
ccgaattggtatatagtttaaac

SEQ ID NO: 1928 - DNA, 23 bp, Artificial Sequence
  gRNA target sequence
ccaaatgcccctcatttacataa

SEQ ID NO: 1929 - DNA, 23 bp, Artificial Sequence
  gRNA target sequence
cccctcatttacataaatattat

SEQ ID NO: 1930 - DNA, 23 bp, Artificial Sequence
  gRNA target sequence
ccctcatttacataaatattata

SEQ ID NO: 1931 - DNA, 23 bp, Artificial Sequence
  gRNA target sequence
cctcatttacataaatattatac

SEQ ID NO: 1932 - DNA, 23 bp, Artificial Sequence
  gRNA target sequence
ccatctcacttctaggaatacta

SEQ ID NO: 1933 - DNA, 23 bp, Artificial Sequence
  gRNA target sequence
cctcatatcctccctactatgcc

SEQ ID NO: 1934 - DNA, 23 bp, Artificial Sequence
  gRNA target sequence
cctccctactatgcctagaagga

SEQ ID NO: 1935 - DNA, 23 bp, Artificial Sequence
  gRNA target sequence
ccctactatgcctagaaggaata

SEQ ID NO: 1936 - DNA, 23 bp, Artificial Sequence
  gRNA target sequence
cctactatgcctagaaggaataa

SEQ ID NO: 1937 - DNA, 23 bp, Artificial Sequence
  gRNA target sequence
cctagaaggaataatactatcgc

SEQ ID NO: 1938 - DNA, 23 bp, Artificial Sequence
  gRNA target sequence
ccctcaacacccactccctctta

SEQ ID NO: 1939 - DNA, 23 bp, Artificial Sequence
  gRNA target sequence
cctcaacacccactccctcttag

SEQ ID NO: 1940 - DNA, 23 bp, Artificial Sequence
  gRNA target sequence
cccactccctcttagccaatatt

SEQ ID NO: 1941 - DNA, 23 bp, Artificial Sequence
  gRNA target sequence
ccactccctcttagccaatattg

SEQ ID NO: 1942 - DNA, 23 bp, Artificial Sequence
  gRNA target sequence
ccctcttagccaatattgtgcct

SEQ ID NO: 1943 - DNA, 23 bp, Artificial Sequence
  gRNA target sequence
cctcttagccaatattgtgccta

SEQ ID NO: 1944 - DNA, 23 bp, Artificial Sequence
  gRNA target sequence
ccaatattgtgcctattgccata

SEQ ID NO: 1945 - DNA, 23 bp, Artificial Sequence
  gRNA target sequence
cctattgccatactagtctttgc

SEQ ID NO: 1946 - DNA, 23 bp, Artificial Sequence
  gRNA target sequence
ccatactagtctttgccgcctgc

SEQ ID NO: 1947 - DNA, 23 bp, Artificial Sequence
  gRNA target sequence
ccgcctgcgaagcagcggtgggc

SEQ ID NO: 1948 - DNA, 23 bp, Artificial Sequence
  gRNA target sequence
cctgcgaagcagcggtgggccta

SEQ ID NO: 1949 - DNA, 23 bp, Artificial Sequence
  gRNA target sequence
cctagccctactagtctcaatct

SEQ ID NO: 1950 - DNA, 23 bp, Artificial Sequence
  gRNA target sequence
ccctactagtctcaatctccaac

SEQ ID NO: 1951 - DNA, 23 bp, Artificial Sequence
  gRNA target sequence
cctactagtctcaatctccaaca

SEQ ID NO: 1952 - DNA, 23 bp, Artificial Sequence
  gRNA target sequence
ccaacacatatggcctagactac

SEQ ID NO: 1953 - DNA, 23 bp, Artificial Sequence
  gRNA target sequence
cctagactacgtacataacctaa

SEQ ID NO: 1954 - DNA, 23 bp, Artificial Sequence
  gRNA target sequence
cctaaacctactccaatgctaaa

SEQ ID NO: 1955 - DNA, 23 bp, Artificial Sequence
  gRNA target sequence
cctactccaatgctaaaactaat

SEQ ID NO: 1956 - DNA, 23 bp, Artificial Sequence
  gRNA target sequence
ccaatgctaaaactaatcgtccc

SEQ ID NO: 1957 - DNA, 23 bp, Artificial Sequence
  gRNA target sequence
cccaacaattatattactaccac

SEQ ID NO: 1958 - DNA, 23 bp, Artificial Sequence
  gRNA target sequence
ccaacaattatattactaccact

SEQ ID NO: 1959 - DNA, 23 bp, Artificial Sequence
  gRNA target sequence
ccactgacatgactttccaaaaa

SEQ ID NO: 1960 - DNA, 23 bp, Artificial Sequence
  gRNA target sequence
ccaaaaaacacataatttgaatc

SEQ ID NO: 1961 - DNA, 23 bp, Artificial Sequence
  gRNA target sequence
ccacccacagcctaattattagc

SEQ ID NO: 1962 - DNA, 23 bp, Artificial Sequence
  gRNA target sequence
cccacagcctaattattagcatc

SEQ ID NO: 1963 - DNA, 23 bp, Artificial Sequence
  gRNA target sequence
ccacagcctaattattagcatca

SEQ ID NO: 1964 - DNA, 23 bp, Artificial Sequence
  gRNA target sequence
cctaattattagcatcatccctc

SEQ ID NO: 1965 - DNA, 23 bp, Artificial Sequence
  gRNA target sequence
ccctctactattttttaaccaaa

SEQ ID NO: 1966 - DNA, 23 bp, Artificial Sequence
  gRNA target sequence
cctctactattttttaaccaaat

SEQ ID NO: 1967 - DNA, 23 bp, Artificial Sequence
  gRNA target sequence
ccaaatcaacaacaacctattta

SEQ ID NO: 1968 - DNA, 23 bp, Artificial Sequence
  gRNA target sequence
cctatttagctgttccccaacct

SEQ ID NO: 1969 - DNA, 23 bp, Artificial Sequence
  gRNA target sequence
ccccaaccttttcctccgacccc

SEQ ID NO: 1970 - DNA, 23 bp, Artificial Sequence
  gRNA target sequence
cccaaccttttcctccgaccccc

SEQ ID NO: 1971 - DNA, 23 bp, Artificial Sequence
  gRNA target sequence
ccaaccttttcctccgaccccct

SEQ ID NO: 1972 - DNA, 23 bp, Artificial Sequence
  gRNA target sequence
ccttttcctccgaccccctaaca

SEQ ID NO: 1973 - DNA, 23 bp, Artificial Sequence
  gRNA target sequence
cctccgaccccctaacaaccccc

SEQ ID NO: 1974 - DNA, 23 bp, Artificial Sequence
  gRNA target sequence
ccgaccccctaacaacccccctc

SEQ ID NO: 1975 - DNA, 23 bp, Artificial Sequence
  gRNA target sequence
ccccctaacaacccccctcctaa

SEQ ID NO: 1976 - DNA, 23 bp, Artificial Sequence
  gRNA target sequence
cccctaacaacccccctcctaat

SEQ ID NO: 1977 - DNA, 23 bp, Artificial Sequence
  gRNA target sequence
ccctaacaacccccctcctaata

SEQ ID NO: 1978 - DNA, 23 bp, Artificial Sequence
  gRNA target sequence
cctaacaacccccctcctaatac

SEQ ID NO: 1979 - DNA, 23 bp, Artificial Sequence
  gRNA target sequence
cccccctcctaatactaactacc

SEQ ID NO: 1980 - DNA, 23 bp, Artificial Sequence
  gRNA target sequence
ccccctcctaatactaactacct

SEQ ID NO: 1981 - DNA, 23 bp, Artificial Sequence
  gRNA target sequence
cccctcctaatactaactacctg

SEQ ID NO: 1982 - DNA, 23 bp, Artificial Sequence
  gRNA target sequence
ccctcctaatactaactacctga

SEQ ID NO: 1983 - DNA, 23 bp, Artificial Sequence
  gRNA target sequence
cctcctaatactaactacctgac

SEQ ID NO: 1984 - DNA, 23 bp, Artificial Sequence
  gRNA target sequence
cctaatactaactacctgactcc

SEQ ID NO: 1985 - DNA, 23 bp, Artificial Sequence
  gRNA target sequence
cctgactcctacccctcacaatc

SEQ ID NO: 1986 - DNA, 23 bp, Artificial Sequence
  gRNA target sequence
cctacccctcacaatcatggcaa

SEQ ID NO: 1987 - DNA, 23 bp, Artificial Sequence
  gRNA target sequence
cccctcacaatcatggcaagcca

SEQ ID NO: 1988 - DNA, 23 bp, Artificial Sequence
  gRNA target sequence
ccctcacaatcatggcaagccaa

SEQ ID NO: 1989 - DNA, 23 bp, Artificial Sequence
  gRNA target sequence
cctcacaatcatggcaagccaac

SEQ ID NO: 1990 - DNA, 23 bp, Artificial Sequence
  gRNA target sequence
ccaacgccacttatccagtgaac

SEQ ID NO: 1991 - DNA, 23 bp, Artificial Sequence
  gRNA target sequence
ccacttatccagtgaaccactat

SEQ ID NO: 1992 - DNA, 23 bp, Artificial Sequence
  gRNA target sequence
ccagtgaaccactatcacgaaaa

SEQ ID NO: 1993 - DNA, 23 bp, Artificial Sequence
  gRNA target sequence
ccactatcacgaaaaaaactcta

SEQ ID NO: 1994 - DNA, 23 bp, Artificial Sequence
  gRNA target sequence
cctctctatactaatctccctac

SEQ ID NO: 1995 - DNA, 23 bp, Artificial Sequence
  gRNA target sequence
ccctacaaatctccttaattata

SEQ ID NO: 1996 - DNA, 23 bp, Artificial Sequence
  gRNA target sequence
cctacaaatctccttaattataa

SEQ ID NO: 1997 - DNA, 23 bp, Artificial Sequence
  gRNA target sequence
ccttaattataacattcacagcc

SEQ ID NO: 1998 - DNA, 23 bp, Artificial Sequence
  gRNA target sequence
ccacagaactaatcatattttat

SEQ ID NO: 1999 - DNA, 23 bp, Artificial Sequence
  gRNA target sequence
ccacacttatccccaccttggct

SEQ ID NO: 2000 - DNA, 23 bp, Artificial Sequence
  gRNA target sequence
ccccaccttggctatcatcaccc

SEQ ID NO: 2001 - DNA, 23 bp, Artificial Sequence
  gRNA target sequence
cccaccttggctatcatcacccg

SEQ ID NO: 2002 - DNA, 23 bp, Artificial Sequence
  gRNA target sequence
ccaccttggctatcatcacccga

SEQ ID NO: 2003 - DNA, 23 bp, Artificial Sequence
  gRNA target sequence
ccttggctatcatcacccgatga

SEQ ID NO: 2004 - DNA, 23 bp, Artificial Sequence
  gRNA target sequence
cccgatgaggcaaccagccagaa

SEQ ID NO: 2005 - DNA, 23 bp, Artificial Sequence
  gRNA target sequence
ccgatgaggcaaccagccagaac

SEQ ID NO: 2006 - DNA, 23 bp, Artificial Sequence
  gRNA target sequence
ccagccagaacgcctgaacgcag

SEQ ID NO: 2007 - DNA, 23 bp, Artificial Sequence
  gRNA target sequence
ccagaacgcctgaacgcaggcac

SEQ ID NO: 2008 - DNA, 23 bp, Artificial Sequence
  gRNA target sequence
cctgaacgcaggcacatacttcc

SEQ ID NO: 2009 - DNA, 23 bp, Artificial Sequence
  gRNA target sequence
cctattctacaccctagtaggct

SEQ ID NO: 2010 - DNA, 23 bp, Artificial Sequence
  gRNA target sequence
ccctagtaggctcccttccccta

SEQ ID NO: 2011 - DNA, 23 bp, Artificial Sequence
  gRNA target sequence
cctagtaggctcccttcccctac

SEQ ID NO: 2012 - DNA, 23 bp, Artificial Sequence
  gRNA target sequence
cccttcccctactcatcgcacta

SEQ ID NO: 2013 - DNA, 23 bp, Artificial Sequence
  gRNA target sequence
ccttcccctactcatcgcactaa

SEQ ID NO: 2014 - DNA, 23 bp, Artificial Sequence
  gRNA target sequence
cccctactcatcgcactaattta

SEQ ID NO: 2015 - DNA, 23 bp, Artificial Sequence
  gRNA target sequence
ccctactcatcgcactaatttac

SEQ ID NO: 2016 - DNA, 23 bp, Artificial Sequence
  gRNA target sequence
cctactcatcgcactaatttaca

SEQ ID NO: 2017 - DNA, 23 bp, Artificial Sequence
  gRNA target sequence
ccctaggctcactaaacattcta

SEQ ID NO: 2018 - DNA, 23 bp, Artificial Sequence
  gRNA target sequence
cctaggctcactaaacattctac

SEQ ID NO: 2019 - DNA, 23 bp, Artificial Sequence
  gRNA target sequence
cccaagaactatcaaactcctga

SEQ ID NO: 2020 - DNA, 23 bp, Artificial Sequence
  gRNA target sequence
ccaagaactatcaaactcctgag

SEQ ID NO: 2021 - DNA, 23 bp, Artificial Sequence
  gRNA target sequence
cctgagccaacaacttaatatga

SEQ ID NO: 2022 - DNA, 23 bp, Artificial Sequence
  gRNA target sequence
ccaacaacttaatatgactagct

SEQ ID NO: 2023 - DNA, 23 bp, Artificial Sequence
  gRNA target sequence
cctctttacggactccacttatg

SEQ ID NO: 2024 - DNA, 23 bp, Artificial Sequence
  gRNA target sequence
ccacttatgactccctaaagccc

SEQ ID NO: 2025 - DNA, 23 bp, Artificial Sequence
  gRNA target sequence
ccctaaagcccatgtcgaagccc

SEQ ID NO: 2026 - DNA, 23 bp, Artificial Sequence
  gRNA target sequence
cctaaagcccatgtcgaagcccc

SEQ ID NO: 2027 - DNA, 23 bp, Artificial Sequence
  gRNA target sequence
cccatgtcgaagcccccatcgct

SEQ ID NO: 2028 - DNA, 23 bp, Artificial Sequence
  gRNA target sequence
ccatgtcgaagcccccatcgctg

SEQ ID NO: 2029 - DNA, 23 bp, Artificial Sequence
  gRNA target sequence
cccccatcgctgggtcaatagta

SEQ ID NO: 2030 - DNA, 23 bp, Artificial Sequence
  gRNA target sequence
ccccatcgctgggtcaatagtac

SEQ ID NO: 2031 - DNA, 23 bp, Artificial Sequence
  gRNA target sequence
cccatcgctgggtcaatagtact

SEQ ID NO: 2032 - DNA, 23 bp, Artificial Sequence
  gRNA target sequence
ccatcgctgggtcaatagtactt

SEQ ID NO: 2033 - DNA, 23 bp, Artificial Sequence
  gRNA target sequence
ccgcagtactcttaaaactaggc

SEQ ID NO: 2034 - DNA, 23 bp, Artificial Sequence
  gRNA target sequence
cctcacactcattctcaaccccc

SEQ ID NO: 2035 - DNA, 23 bp, Artificial Sequence
  gRNA target sequence
ccccctgacaaaacacatagcct

SEQ ID NO: 2036 - DNA, 23 bp, Artificial Sequence
  gRNA target sequence
cccctgacaaaacacatagccta

SEQ ID NO: 2037 - DNA, 23 bp, Artificial Sequence
  gRNA target sequence
ccctgacaaaacacatagcctac

SEQ ID NO: 2038 - DNA, 23 bp, Artificial Sequence
  gRNA target sequence
cctgacaaaacacatagcctacc

SEQ ID NO: 2039 - DNA, 23 bp, Artificial Sequence
  gRNA target sequence
cctaccccttccttgtactatcc

SEQ ID NO: 2040 - DNA, 23 bp, Artificial Sequence
  gRNA target sequence
ccccttccttgtactatccctat

SEQ ID NO: 2041 - DNA, 23 bp, Artificial Sequence
  gRNA target sequence
cccttccttgtactatccctatg

SEQ ID NO: 2042 - DNA, 23 bp, Artificial Sequence
  gRNA target sequence
ccttccttgtactatccctatga

SEQ ID NO: 2043 - DNA, 23 bp, Artificial Sequence
  gRNA target sequence
ccttgtactatccctatgaggca

SEQ ID NO: 2044 - DNA, 23 bp, Artificial Sequence
  gRNA target sequence
ccctatgaggcataattataaca

SEQ ID NO: 2045 - DNA, 23 bp, Artificial Sequence
  gRNA target sequence
cctatgaggcataattataacaa

SEQ ID NO: 2046 - DNA, 23 bp, Artificial Sequence
  gRNA target sequence
ccatctgcctacgacaaacagac

SEQ ID NO: 2047 - DNA, 23 bp, Artificial Sequence
  gRNA target sequence
cctacgacaaacagacctaaaat

SEQ ID NO: 2048 - DNA, 23 bp, Artificial Sequence
  gRNA target sequence
cctaaaatcgctcattgcatact

SEQ ID NO: 2049 - DNA, 23 bp, Artificial Sequence
  gRNA target sequence
ccacatagccctcgtagtaacag

SEQ ID NO: 2050 - DNA, 23 bp, Artificial Sequence
  gRNA target sequence
ccctcgtagtaacagccattctc

SEQ ID NO: 2051 - DNA, 23 bp, Artificial Sequence
  gRNA target sequence
cctcgtagtaacagccattctca

SEQ ID NO: 2052 - DNA, 23 bp, Artificial Sequence
  gRNA target sequence
ccattctcatccaaaccccctga

SEQ ID NO: 2053 - DNA, 23 bp, Artificial Sequence
  gRNA target sequence
ccaaaccccctgaagcttcaccg

SEQ ID NO: 2054 - DNA, 23 bp, Artificial Sequence
  gRNA target sequence
ccccctgaagcttcaccggcgca

SEQ ID NO: 2055 - DNA, 23 bp, Artificial Sequence
  gRNA target sequence
cccctgaagcttcaccggcgcag

SEQ ID NO: 2056 - DNA, 23 bp, Artificial Sequence
  gRNA target sequence
ccctgaagcttcaccggcgcagt

SEQ ID NO: 2057 - DNA, 23 bp, Artificial Sequence
  gRNA target sequence
cctgaagcttcaccggcgcagtc

SEQ ID NO: 2058 - DNA, 23 bp, Artificial Sequence
  gRNA target sequence
ccggcgcagtcattctcataatc

SEQ ID NO: 2059 - DNA, 23 bp, Artificial Sequence
  gRNA target sequence
cccacgggcttacatcctcatta

SEQ ID NO: 2060 - DNA, 23 bp, Artificial Sequence
  gRNA target sequence
ccacgggcttacatcctcattac

SEQ ID NO: 2061 - DNA, 23 bp, Artificial Sequence
  gRNA target sequence
cctcattactattctgcctagca

SEQ ID NO: 2062 - DNA, 23 bp, Artificial Sequence
  gRNA target sequence
cctagcaaactcaaactacgaac

SEQ ID NO: 2063 - DNA, 23 bp, Artificial Sequence
  gRNA target sequence
cctctctcaaggacttcaaactc

SEQ ID NO: 2064 - DNA, 23 bp, Artificial Sequence
  gRNA target sequence
cccactaatagctttttgatgac

SEQ ID NO: 2065 - DNA, 23 bp, Artificial Sequence
  gRNA target sequence
ccactaatagctttttgatgact

SEQ ID NO: 2066 - DNA, 23 bp, Artificial Sequence
  gRNA target sequence
cctcgctaacctcgccttacccc

SEQ ID NO: 2067 - DNA, 23 bp, Artificial Sequence
  gRNA target sequence
cctcgccttaccccccactatta

SEQ ID NO: 2068 - DNA, 23 bp, Artificial Sequence
  gRNA target sequence
ccttaccccccactattaaccta

SEQ ID NO: 2069 - DNA, 23 bp, Artificial Sequence
  gRNA target sequence
ccccccactattaacctactggg

SEQ ID NO: 2070 - DNA, 23 bp, Artificial Sequence
  gRNA target sequence
cccccactattaacctactggga

SEQ ID NO: 2071 - DNA, 23 bp, Artificial Sequence
  gRNA target sequence
ccccactattaacctactgggag

SEQ ID NO: 2072 - DNA, 23 bp, Artificial Sequence
  gRNA target sequence
cccactattaacctactgggaga

SEQ ID NO: 2073 - DNA, 23 bp, Artificial Sequence
  gRNA target sequence
ccactattaacctactgggagaa

SEQ ID NO: 2074 - DNA, 23 bp, Artificial Sequence
  gRNA target sequence
cctactgggagaactctctgtgc

SEQ ID NO: 2075 - DNA, 23 bp, Artificial Sequence
  gRNA target sequence
ccacgttctcctgatcaaatatc

SEQ ID NO: 2076 - DNA, 23 bp, Artificial Sequence
  gRNA target sequence
cctgatcaaatatcactctccta

SEQ ID NO: 2077 - DNA, 23 bp, Artificial Sequence
  gRNA target sequence
cctacttacaggactcaacatac

SEQ ID NO: 2078 - DNA, 23 bp, Artificial Sequence
  gRNA target sequence
ccctatactccctctacatattt

SEQ ID NO: 2079 - DNA, 23 bp, Artificial Sequence
  gRNA target sequence
cctatactccctctacatattta

SEQ ID NO: 2080 - DNA, 23 bp, Artificial Sequence
  gRNA target sequence
ccctctacatatttaccacaaca

SEQ ID NO: 2081 - DNA, 23 bp, Artificial Sequence
  gRNA target sequence
cctctacatatttaccacaacac

SEQ ID NO: 2082 - DNA, 23 bp, Artificial Sequence
  gRNA target sequence
ccacaacacaatggggctcactc

SEQ ID NO: 2083 - DNA, 23 bp, Artificial Sequence
  gRNA target sequence
cccaccacattaacaacataaaa

SEQ ID NO: 2084 - DNA, 23 bp, Artificial Sequence
  gRNA target sequence
ccaccacattaacaacataaaac

SEQ ID NO: 2085 - DNA, 23 bp, Artificial Sequence
  gRNA target sequence
ccacattaacaacataaaaccct

SEQ ID NO: 2086 - DNA, 23 bp, Artificial Sequence
  gRNA target sequence
ccctcattcacacgagaaaacac

SEQ ID NO: 2087 - DNA, 23 bp, Artificial Sequence
  gRNA target sequence
cctcattcacacgagaaaacacc

SEQ ID NO: 2088 - DNA, 23 bp, Artificial Sequence
  gRNA target sequence
ccctcatgttcatacacctatcc

SEQ ID NO: 2089 - DNA, 23 bp, Artificial Sequence
  gRNA target sequence
cctcatgttcatacacctatccc

SEQ ID NO: 2090 - DNA, 23 bp, Artificial Sequence
  gRNA target sequence
cctatcccccattctcctcctat

SEQ ID NO: 2091 - DNA, 23 bp, Artificial Sequence
  gRNA target sequence
cccccattctcctcctatccctc

SEQ ID NO: 2092 - DNA, 23 bp, Artificial Sequence
  gRNA target sequence
ccccattctcctcctatccctca

SEQ ID NO: 2093 - DNA, 23 bp, Artificial Sequence
  gRNA target sequence
cccattctcctcctatccctcaa

SEQ ID NO: 2094 - DNA, 23 bp, Artificial Sequence
  gRNA target sequence
ccattctcctcctatccctcaac

SEQ ID NO: 2095 - DNA, 23 bp, Artificial Sequence
  gRNA target sequence
cctcctatccctcaaccccgaca

SEQ ID NO: 2096 - DNA, 23 bp, Artificial Sequence
  gRNA target sequence
cctatccctcaaccccgacatca

SEQ ID NO: 2097 - DNA, 23 bp, Artificial Sequence
  gRNA target sequence
ccctcaaccccgacatcattacc

SEQ ID NO: 2098 - DNA, 23 bp, Artificial Sequence
  gRNA target sequence
cctcaaccccgacatcattaccg

SEQ ID NO: 2099 - DNA, 23 bp, Artificial Sequence
  gRNA target sequence
ccccgacatcattaccgggtttt

SEQ ID NO: 2100 - DNA, 23 bp, Artificial Sequence
  gRNA target sequence
cccgacatcattaccgggttttc

SEQ ID NO: 2101 - DNA, 23 bp, Artificial Sequence
  gRNA target sequence
ccgacatcattaccgggttttcc

SEQ ID NO: 2102 - DNA, 23 bp, Artificial Sequence
  gRNA target sequence
ccgggttttcctcttgtaaatat

SEQ ID NO: 2103 - DNA, 23 bp, Artificial Sequence
  gRNA target sequence
cctcttgtaaatatagtttaacc

SEQ ID NO: 2104 - DNA, 23 bp, Artificial Sequence
  gRNA target sequence
ccaaaacatcagattgtgaatct

SEQ ID NO: 2105 - DNA, 23 bp, Artificial Sequence
  gRNA target sequence
ccccttatttaccgagaaagctc

SEQ ID NO: 2106 - DNA, 23 bp, Artificial Sequence
  gRNA target sequence
cccttatttaccgagaaagctca

SEQ ID NO: 2107 - DNA, 23 bp, Artificial Sequence
  gRNA target sequence
ccttatttaccgagaaagctcac

SEQ ID NO: 2108 - DNA, 23 bp, Artificial Sequence
  gRNA target sequence
ccgagaaagctcacaagaactgc

SEQ ID NO: 2109 - DNA, 23 bp, Artificial Sequence
  gRNA target sequence
cccccatgtctaacaacatggct

SEQ ID NO: 2110 - DNA, 23 bp, Artificial Sequence
  gRNA target sequence
ccccatgtctaacaacatggctt

SEQ ID NO: 2111 - DNA, 23 bp, Artificial Sequence
  gRNA target sequence
cccatgtctaacaacatggcttt

SEQ ID NO: 2112 - DNA, 23 bp, Artificial Sequence
  gRNA target sequence
ccatgtctaacaacatggctttc

SEQ ID NO: 2113 - DNA, 23 bp, Artificial Sequence
  gRNA target sequence
ccattggtcttaggccccaaaaa

SEQ ID NO: 2114 - DNA, 23 bp, Artificial Sequence
  gRNA target sequence
ccccaaaaattttggtgcaactc

SEQ ID NO: 2115 - DNA, 23 bp, Artificial Sequence
  gRNA target sequence
cccaaaaattttggtgcaactcc

SEQ ID NO: 2116 - DNA, 23 bp, Artificial Sequence
  gRNA target sequence
ccaaaaattttggtgcaactcca

SEQ ID NO: 2117 - DNA, 23 bp, Artificial Sequence
  gRNA target sequence
ccaaataaaagtaataaccatgc

SEQ ID NO: 2118 - DNA, 23 bp, Artificial Sequence
  gRNA target sequence
ccatgcacactactataaccacc

SEQ ID NO: 2119 - DNA, 23 bp, Artificial Sequence
  gRNA target sequence
ccaccctaaccctgacttcccta

SEQ ID NO: 2120 - DNA, 23 bp, Artificial Sequence
  gRNA target sequence
ccctaaccctgacttccctaatt

SEQ ID NO: 2121 - DNA, 23 bp, Artificial Sequence
  gRNA target sequence
cctaaccctgacttccctaattc

SEQ ID NO: 2122 - DNA, 23 bp, Artificial Sequence
  gRNA target sequence
ccctgacttccctaattcccccc

SEQ ID NO: 2123 - DNA, 23 bp, Artificial Sequence
  gRNA target sequence
cctgacttccctaattcccccca

SEQ ID NO: 2124 - DNA, 23 bp, Artificial Sequence
  gRNA target sequence
ccctaattccccccatccttacc

SEQ ID NO: 2125 - DNA, 23 bp, Artificial Sequence
  gRNA target sequence
cctaattccccccatccttacca

SEQ ID NO: 2126 - DNA, 23 bp, Artificial Sequence
  gRNA target sequence
ccccccatccttaccaccctcgt

SEQ ID NO: 2127 - DNA, 23 bp, Artificial Sequence
  gRNA target sequence
cccccatccttaccaccctcgtt

SEQ ID NO: 2128 - DNA, 23 bp, Artificial Sequence
  gRNA target sequence
ccccatccttaccaccctcgtta

SEQ ID NO: 2129 - DNA, 23 bp, Artificial Sequence
  gRNA target sequence
cccatccttaccaccctcgttaa

SEQ ID NO: 2130 - DNA, 23 bp, Artificial Sequence
  gRNA target sequence
ccatccttaccaccctcgttaac

SEQ ID NO: 2131 - DNA, 23 bp, Artificial Sequence
  gRNA target sequence
ccttaccaccctcgttaacccta

SEQ ID NO: 2132 - DNA, 23 bp, Artificial Sequence
  gRNA target sequence
ccaccctcgttaaccctaacaaa

SEQ ID NO: 2133 - DNA, 23 bp, Artificial Sequence
  gRNA target sequence
ccctcgttaaccctaacaaaaaa

SEQ ID NO: 2134 - DNA, 23 bp, Artificial Sequence
  gRNA target sequence
cctcgttaaccctaacaaaaaaa

SEQ ID NO: 2135 - DNA, 23 bp, Artificial Sequence
  gRNA target sequence
ccctaacaaaaaaaactcatacc

SEQ ID NO: 2136 - DNA, 23 bp, Artificial Sequence
  gRNA target sequence
cctaacaaaaaaaactcataccc

SEQ ID NO: 2137 - DNA, 23 bp, Artificial Sequence
  gRNA target sequence
cccccattatgtaaaatccattg

SEQ ID NO: 2138 - DNA, 23 bp, Artificial Sequence
  gRNA target sequence
ccccattatgtaaaatccattgt

SEQ ID NO: 2139 - DNA, 23 bp, Artificial Sequence
  gRNA target sequence
cccattatgtaaaatccattgtc

SEQ ID NO: 2140 - DNA, 23 bp, Artificial Sequence
  gRNA target sequence
ccattatgtaaaatccattgtcg

SEQ ID NO: 2141 - DNA, 23 bp, Artificial Sequence
  gRNA target sequence
ccattgtcgcatccacctttatt

SEQ ID NO: 2142 - DNA, 23 bp, Artificial Sequence
  gRNA target sequence
ccacctttattatcagtctcttc

SEQ ID NO: 2143 - DNA, 23 bp, Artificial Sequence
  gRNA target sequence
cctttattatcagtctcttcccc

SEQ ID NO: 2144 - DNA, 23 bp, Artificial Sequence
  gRNA target sequence
ccccacaacaatattcatgtgcc

SEQ ID NO: 2145 - DNA, 23 bp, Artificial Sequence
  gRNA target sequence
cccacaacaatattcatgtgcct

SEQ ID NO: 2146 - DNA, 23 bp, Artificial Sequence
  gRNA target sequence
ccacaacaatattcatgtgccta

SEQ ID NO: 2147 - DNA, 23 bp, Artificial Sequence
  gRNA target sequence
cctagaccaagaagttattatct

SEQ ID NO: 2148 - DNA, 23 bp, Artificial Sequence
  gRNA target sequence
ccaagaagttattatctcgaact

SEQ ID NO: 2149 - DNA, 23 bp, Artificial Sequence
  gRNA target sequence
ccacaacccaaacaacccagctc

SEQ ID NO: 2150 - DNA, 23 bp, Artificial Sequence
  gRNA target sequence
cccaaacaacccagctctcccta

SEQ ID NO: 2151 - DNA, 23 bp, Artificial Sequence
  gRNA target sequence
ccaaacaacccagctctccctaa

SEQ ID NO: 2152 - DNA, 23 bp, Artificial Sequence
  gRNA target sequence
cccagctctccctaagcttcaaa

SEQ ID NO: 2153 - DNA, 23 bp, Artificial Sequence
  gRNA target sequence
ccagctctccctaagcttcaaac

SEQ ID NO: 2154 - DNA, 23 bp, Artificial Sequence
  gRNA target sequence
ccctaagcttcaaactagactac

SEQ ID NO: 2155 - DNA, 23 bp, Artificial Sequence
  gRNA target sequence
cctaagcttcaaactagactact

SEQ ID NO: 2156 - DNA, 23 bp, Artificial Sequence
  gRNA target sequence
ccataatattcatccctgtagca

SEQ ID NO: 2157 - DNA, 23 bp, Artificial Sequence
  gRNA target sequence
ccctgtagcattgttcgttacat

SEQ ID NO: 2158 - DNA, 23 bp, Artificial Sequence
  gRNA target sequence
cctgtagcattgttcgttacatg

SEQ ID NO: 2159 - DNA, 23 bp, Artificial Sequence
  gRNA target sequence
ccatcatagaattctcactgtga

SEQ ID NO: 2160 - DNA, 23 bp, Artificial Sequence
  gRNA target sequence
cccaaacattaatcagttcttca

SEQ ID NO: 2161 - DNA, 23 bp, Artificial Sequence
  gRNA target sequence
ccaaacattaatcagttcttcaa

SEQ ID NO: 2162 - DNA, 23 bp, Artificial Sequence
  gRNA target sequence
cctaattaccatactaatcttag

SEQ ID NO: 2163 - DNA, 23 bp, Artificial Sequence
  gRNA target sequence
ccatactaatcttagttaccgct

SEQ ID NO: 2164 - DNA, 23 bp, Artificial Sequence
  gRNA target sequence
ccgctaacaacctattccaactg

SEQ ID NO: 2165 - DNA, 23 bp, Artificial Sequence
  gRNA target sequence
cctattccaactgttcatcggct

SEQ ID NO: 2166 - DNA, 23 bp, Artificial Sequence
  gRNA target sequence
ccaactgttcatcggctgagagg

SEQ ID NO: 2167 - DNA, 23 bp, Artificial Sequence
  gRNA target sequence
ccttcttgctcatcagttgatga

SEQ ID NO: 2168 - DNA, 23 bp, Artificial Sequence
  gRNA target sequence
cccgagcagatgccaacacagca

SEQ ID NO: 2169 - DNA, 23 bp, Artificial Sequence
  gRNA target sequence
ccgagcagatgccaacacagcag

SEQ ID NO: 2170 - DNA, 23 bp, Artificial Sequence
  gRNA target sequence
ccaacacagcagccattcaagca

SEQ ID NO: 2171 - DNA, 23 bp, Artificial Sequence
  gRNA target sequence
ccattcaagcaatcctatacaac

SEQ ID NO: 2172 - DNA, 23 bp, Artificial Sequence
  gRNA target sequence
cctatacaaccgtatcggcgata

SEQ ID NO: 2173 - DNA, 23 bp, Artificial Sequence
  gRNA target sequence
ccgtatcggcgatatcggtttca

SEQ ID NO: 2174 - DNA, 23 bp, Artificial Sequence
  gRNA target sequence
cctcgccttagcatgatttatcc

SEQ ID NO: 2175 - DNA, 23 bp, Artificial Sequence
  gRNA target sequence
ccttagcatgatttatcctacac

SEQ ID NO: 2176 - DNA, 23 bp, Artificial Sequence
  gRNA target sequence
cctacactccaactcatgagacc

SEQ ID NO: 2177 - DNA, 23 bp, Artificial Sequence
  gRNA target sequence
ccaactcatgagacccacaacaa

SEQ ID NO: 2178 - DNA, 23 bp, Artificial Sequence
  gRNA target sequence
cccacaacaaatagcccttctaa

SEQ ID NO: 2179 - DNA, 23 bp, Artificial Sequence
  gRNA target sequence
ccacaacaaatagcccttctaaa

SEQ ID NO: 2180 - DNA, 23 bp, Artificial Sequence
  gRNA target sequence
cccttctaaacgctaatccaagc

SEQ ID NO: 2181 - DNA, 23 bp, Artificial Sequence
  gRNA target sequence
ccttctaaacgctaatccaagcc

SEQ ID NO: 2182 - DNA, 23 bp, Artificial Sequence
  gRNA target sequence
ccaagcctcaccccactactagg

SEQ ID NO: 2183 - DNA, 23 bp, Artificial Sequence
  gRNA target sequence
cctcaccccactactaggcctcc

SEQ ID NO: 2184 - DNA, 23 bp, Artificial Sequence
  gRNA target sequence
ccccactactaggcctcctccta

SEQ ID NO: 2185 - DNA, 23 bp, Artificial Sequence
  gRNA target sequence
cccactactaggcctcctcctag

SEQ ID NO: 2186 - DNA, 23 bp, Artificial Sequence
  gRNA target sequence
ccactactaggcctcctcctagc

SEQ ID NO: 2187 - DNA, 23 bp, Artificial Sequence
  gRNA target sequence
cctcctcctagcagcagcaggca

SEQ ID NO: 2188 - DNA, 23 bp, Artificial Sequence
  gRNA target sequence
cctcctagcagcagcaggcaaat

SEQ ID NO: 2189 - DNA, 23 bp, Artificial Sequence
  gRNA target sequence
cctagcagcagcaggcaaatcag

SEQ ID NO: 2190 - DNA, 23 bp, Artificial Sequence
  gRNA target sequence
cccaattaggtctccacccctga

SEQ ID NO: 2191 - DNA, 23 bp, Artificial Sequence
  gRNA target sequence
ccaattaggtctccacccctgac

SEQ ID NO: 2192 - DNA, 23 bp, Artificial Sequence
  gRNA target sequence
ccacccctgactcccctcagcca

SEQ ID NO: 2193 - DNA, 23 bp, Artificial Sequence
  gRNA target sequence
cccctgactcccctcagccatag

SEQ ID NO: 2194 - DNA, 23 bp, Artificial Sequence
  gRNA target sequence
ccctgactcccctcagccataga

SEQ ID NO: 2195 - DNA, 23 bp, Artificial Sequence
  gRNA target sequence
cctgactcccctcagccatagaa

SEQ ID NO: 2196 - DNA, 23 bp, Artificial Sequence
  gRNA target sequence
cccctcagccatagaaggcccca

SEQ ID NO: 2197 - DNA, 23 bp, Artificial Sequence
  gRNA target sequence
ccctcagccatagaaggccccac

SEQ ID NO: 2198 - DNA, 23 bp, Artificial Sequence
  gRNA target sequence
cctcagccatagaaggccccacc

SEQ ID NO: 2199 - DNA, 23 bp, Artificial Sequence
  gRNA target sequence
ccatagaaggccccaccccagtc

SEQ ID NO: 2200 - DNA, 23 bp, Artificial Sequence
  gRNA target sequence
ccccaccccagtctcagccctac

SEQ ID NO: 2201 - DNA, 23 bp, Artificial Sequence
  gRNA target sequence
cccaccccagtctcagccctact

SEQ ID NO: 2202 - DNA, 23 bp, Artificial Sequence
  gRNA target sequence
ccaccccagtctcagccctactc

SEQ ID NO: 2203 - DNA, 23 bp, Artificial Sequence
  gRNA target sequence
ccccagtctcagccctactccac

SEQ ID NO: 2204 - DNA, 23 bp, Artificial Sequence
  gRNA target sequence
cccagtctcagccctactccact

SEQ ID NO: 2205 - DNA, 23 bp, Artificial Sequence
  gRNA target sequence
ccagtctcagccctactccactc

SEQ ID NO: 2206 - DNA, 23 bp, Artificial Sequence
  gRNA target sequence
ccctactccactcaagcactata

SEQ ID NO: 2207 - DNA, 23 bp, Artificial Sequence
  gRNA target sequence
cctactccactcaagcactatag

SEQ ID NO: 2208 - DNA, 23 bp, Artificial Sequence
  gRNA target sequence
ccactcaagcactatagttgtag

SEQ ID NO: 2209 - DNA, 23 bp, Artificial Sequence
  gRNA target sequence
ccgcttccaccccctagcagaaa

SEQ ID NO: 2210 - DNA, 23 bp, Artificial Sequence
  gRNA target sequence
ccaccccctagcagaaaatagcc

SEQ ID NO: 2211 - DNA, 23 bp, Artificial Sequence
  gRNA target sequence
ccccctagcagaaaatagcccac

SEQ ID NO: 2212 - DNA, 23 bp, Artificial Sequence
  gRNA target sequence
cccctagcagaaaatagcccact

SEQ ID NO: 2213 - DNA, 23 bp, Artificial Sequence
  gRNA target sequence
ccctagcagaaaatagcccacta

SEQ ID NO: 2214 - DNA, 23 bp, Artificial Sequence
  gRNA target sequence
cctagcagaaaatagcccactaa

SEQ ID NO: 2215 - DNA, 23 bp, Artificial Sequence
  gRNA target sequence
cccactaatccaaactctaacac

SEQ ID NO: 2216 - DNA, 23 bp, Artificial Sequence
  gRNA target sequence
ccactaatccaaactctaacact

SEQ ID NO: 2217 - DNA, 23 bp, Artificial Sequence
  gRNA target sequence
ccaaactctaacactatgcttag

SEQ ID NO: 2218 - DNA, 23 bp, Artificial Sequence
  gRNA target sequence
ccactctgttcgcagcagtctgc

SEQ ID NO: 2219 - DNA, 23 bp, Artificial Sequence
  gRNA target sequence
cccttacacaaaatgacatcaaa

SEQ ID NO: 2220 - DNA, 23 bp, Artificial Sequence
  gRNA target sequence
ccttacacaaaatgacatcaaaa

SEQ ID NO: 2221 - DNA, 23 bp, Artificial Sequence
  gRNA target sequence
ccttctccacttcaagtcaacta

SEQ ID NO: 2222 - DNA, 23 bp, Artificial Sequence
  gRNA target sequence
ccacttcaagtcaactaggactc

SEQ ID NO: 2223 - DNA, 23 bp, Artificial Sequence
  gRNA target sequence
ccaaccacacctagcattcctgc

SEQ ID NO: 2224 - DNA, 23 bp, Artificial Sequence
  gRNA target sequence
ccacacctagcattcctgcacat

SEQ ID NO: 2225 - DNA, 23 bp, Artificial Sequence
  gRNA target sequence
cctagcattcctgcacatctgta

SEQ ID NO: 2226 - DNA, 23 bp, Artificial Sequence
  gRNA target sequence
cctgcacatctgtacccacgcct

SEQ ID NO: 2227 - DNA, 23 bp, Artificial Sequence
  gRNA target sequence
cccacgccttcttcaaagccata

SEQ ID NO: 2228 - DNA, 23 bp, Artificial Sequence
  gRNA target sequence
ccacgccttcttcaaagccatac

SEQ ID NO: 2229 - DNA, 23 bp, Artificial Sequence
  gRNA target sequence
ccttcttcaaagccatactattt

SEQ ID NO: 2230 - DNA, 23 bp, Artificial Sequence
  gRNA target sequence
ccatactatttatgtgctccggg

SEQ ID NO: 2231 - DNA, 23 bp, Artificial Sequence
  gRNA target sequence
ccgggtccatcatccacaacctt

SEQ ID NO: 2232 - DNA, 23 bp, Artificial Sequence
  gRNA target sequence
ccatcatccacaaccttaacaat

SEQ ID NO: 2233 - DNA, 23 bp, Artificial Sequence
  gRNA target sequence
ccacaaccttaacaatgaacaag

SEQ ID NO: 2234 - DNA, 23 bp, Artificial Sequence
  gRNA target sequence
ccttaacaatgaacaagatattc

SEQ ID NO: 2235 - DNA, 23 bp, Artificial Sequence
  gRNA target sequence
ccatacctctcacttcaacctcc

SEQ ID NO: 2236 - DNA, 23 bp, Artificial Sequence
  gRNA target sequence
cctctcacttcaacctccctcac

SEQ ID NO: 2237 - DNA, 23 bp, Artificial Sequence
  gRNA target sequence
cctccctcaccattggcagccta

SEQ ID NO: 2238 - DNA, 23 bp, Artificial Sequence
  gRNA target sequence
ccctcaccattggcagcctagca

SEQ ID NO: 2239 - DNA, 23 bp, Artificial Sequence
  gRNA target sequence
cctcaccattggcagcctagcat

SEQ ID NO: 2240 - DNA, 23 bp, Artificial Sequence
  gRNA target sequence
ccattggcagcctagcattagca

SEQ ID NO: 2241 - DNA, 23 bp, Artificial Sequence
  gRNA target sequence
cctagcattagcaggaatacctt

SEQ ID NO: 2242 - DNA, 23 bp, Artificial Sequence
  gRNA target sequence
cctttcctcacaggtttctactc

SEQ ID NO: 2243 - DNA, 23 bp, Artificial Sequence
  gRNA target sequence
cctcacaggtttctactccaaag

SEQ ID NO: 2244 - DNA, 23 bp, Artificial Sequence
  gRNA target sequence
ccaaagaccacatcatcgaaacc

SEQ ID NO: 2245 - DNA, 23 bp, Artificial Sequence
  gRNA target sequence
ccacatcatcgaaaccgcaaaca

SEQ ID NO: 2246 - DNA, 23 bp, Artificial Sequence
  gRNA target sequence
ccgcaaacatatcatacacaaac

SEQ ID NO: 2247 - DNA, 23 bp, Artificial Sequence
  gRNA target sequence
cctgagccctatctattactctc

SEQ ID NO: 2248 - DNA, 23 bp, Artificial Sequence
  gRNA target sequence
ccctatctattactctcatcgct

SEQ ID NO: 2249 - DNA, 23 bp, Artificial Sequence
  gRNA target sequence
cctatctattactctcatcgcta

SEQ ID NO: 2250 - DNA, 23 bp, Artificial Sequence
  gRNA target sequence
cctccctgacaagcgcctatagc

SEQ ID NO: 2251 - DNA, 23 bp, Artificial Sequence
  gRNA target sequence
ccctgacaagcgcctatagcact

SEQ ID NO: 2252 - DNA, 23 bp, Artificial Sequence
  gRNA target sequence
cctgacaagcgcctatagcactc

SEQ ID NO: 2253 - DNA, 23 bp, Artificial Sequence
  gRNA target sequence
cctatagcactcgaataattctt

SEQ ID NO: 2254 - DNA, 23 bp, Artificial Sequence
  gRNA target sequence
ccctaacaggtcaacctcgcttc

SEQ ID NO: 2255 - DNA, 23 bp, Artificial Sequence
  gRNA target sequence
cctaacaggtcaacctcgcttcc

SEQ ID NO: 2256 - DNA, 23 bp, Artificial Sequence
  gRNA target sequence
cctcgcttccccacccttactaa

SEQ ID NO: 2257 - DNA, 23 bp, Artificial Sequence
  gRNA target sequence
ccccacccttactaacattaacg

SEQ ID NO: 2258 - DNA, 23 bp, Artificial Sequence
  gRNA target sequence
cccacccttactaacattaacga

SEQ ID NO: 2259 - DNA, 23 bp, Artificial Sequence
  gRNA target sequence
ccacccttactaacattaacgaa

SEQ ID NO: 2260 - DNA, 23 bp, Artificial Sequence
  gRNA target sequence
cccttactaacattaacgaaaat

SEQ ID NO: 2261 - DNA, 23 bp, Artificial Sequence
  gRNA target sequence
ccttactaacattaacgaaaata

SEQ ID NO: 2262 - DNA, 23 bp, Artificial Sequence
  gRNA target sequence
ccccaccctactaaaccccatta

SEQ ID NO: 2263 - DNA, 23 bp, Artificial Sequence
  gRNA target sequence
cccaccctactaaaccccattaa

SEQ ID NO: 2264 - DNA, 23 bp, Artificial Sequence
  gRNA target sequence
ccaccctactaaaccccattaaa

SEQ ID NO: 2265 - DNA, 23 bp, Artificial Sequence
  gRNA target sequence
ccctactaaaccccattaaacgc

SEQ ID NO: 2266 - DNA, 23 bp, Artificial Sequence
  gRNA target sequence
cctactaaaccccattaaacgcc

SEQ ID NO: 2267 - DNA, 23 bp, Artificial Sequence
  gRNA target sequence
ccccattaaacgcctggcagccg

SEQ ID NO: 2268 - DNA, 23 bp, Artificial Sequence
  gRNA target sequence
cccattaaacgcctggcagccgg

SEQ ID NO: 2269 - DNA, 23 bp, Artificial Sequence
  gRNA target sequence
ccattaaacgcctggcagccgga

SEQ ID NO: 2270 - DNA, 23 bp, Artificial Sequence
  gRNA target sequence
cctggcagccggaagcctattcg

SEQ ID NO: 2271 - DNA, 23 bp, Artificial Sequence
  gRNA target sequence
ccggaagcctattcgcaggattt

SEQ ID NO: 2272 - DNA, 23 bp, Artificial Sequence
  gRNA target sequence
cctattcgcaggatttctcatta

SEQ ID NO: 2273 - DNA, 23 bp, Artificial Sequence
  gRNA target sequence
cccccgcatcccccttccaaaca

SEQ ID NO: 2274 - DNA, 23 bp, Artificial Sequence
  gRNA target sequence
ccccgcatcccccttccaaacaa

SEQ ID NO: 2275 - DNA, 23 bp, Artificial Sequence
  gRNA target sequence
cccgcatcccccttccaaacaac

SEQ ID NO: 2276 - DNA, 23 bp, Artificial Sequence
  gRNA target sequence
ccgcatcccccttccaaacaaca

SEQ ID NO: 2277 - DNA, 23 bp, Artificial Sequence
  gRNA target sequence
cccccttccaaacaacaatcccc

SEQ ID NO: 2278 - DNA, 23 bp, Artificial Sequence
  gRNA target sequence
ccccttccaaacaacaatccccc

SEQ ID NO: 2279 - DNA, 23 bp, Artificial Sequence
  gRNA target sequence
cccttccaaacaacaatccccct

SEQ ID NO: 2280 - DNA, 23 bp, Artificial Sequence
  gRNA target sequence
ccttccaaacaacaatccccctc

SEQ ID NO: 2281 - DNA, 23 bp, Artificial Sequence
  gRNA target sequence
ccaaacaacaatccccctctacc

SEQ ID NO: 2282 - DNA, 23 bp, Artificial Sequence
  gRNA target sequence
ccccctctacctaaaactcacag

SEQ ID NO: 2283 - DNA, 23 bp, Artificial Sequence
  gRNA target sequence
cccctctacctaaaactcacagc

SEQ ID NO: 2284 - DNA, 23 bp, Artificial Sequence
  gRNA target sequence
ccctctacctaaaactcacagcc

SEQ ID NO: 2285 - DNA, 23 bp, Artificial Sequence
  gRNA target sequence
cctctacctaaaactcacagccc

SEQ ID NO: 2286 - DNA, 23 bp, Artificial Sequence
  gRNA target sequence
cctaaaactcacagccctcgctg

SEQ ID NO: 2287 - DNA, 23 bp, Artificial Sequence
  gRNA target sequence
ccctcgctgtcactttcctagga

SEQ ID NO: 2288 - DNA, 23 bp, Artificial Sequence
  gRNA target sequence
cctcgctgtcactttcctaggac

SEQ ID NO: 2289 - DNA, 23 bp, Artificial Sequence
  gRNA target sequence
cctaggacttctaacagccctag

SEQ ID NO: 2290 - DNA, 23 bp, Artificial Sequence
  gRNA target sequence
ccctagacctcaactacctaacc

SEQ ID NO: 2291 - DNA, 23 bp, Artificial Sequence
  gRNA target sequence
cctagacctcaactacctaacca

SEQ ID NO: 2292 - DNA, 23 bp, Artificial Sequence
  gRNA target sequence
cctcaactacctaaccaacaaac

SEQ ID NO: 2293 - DNA, 23 bp, Artificial Sequence
  gRNA target sequence
cctaaccaacaaacttaaaataa

SEQ ID NO: 2294 - DNA, 23 bp, Artificial Sequence
  gRNA target sequence
ccaacaaacttaaaataaaatcc

SEQ ID NO: 2295 - DNA, 23 bp, Artificial Sequence
  gRNA target sequence
ccccactatgcacattttatttc

SEQ ID NO: 2296 - DNA, 23 bp, Artificial Sequence
  gRNA target sequence
cccactatgcacattttatttct

SEQ ID NO: 2297 - DNA, 23 bp, Artificial Sequence
  gRNA target sequence
ccactatgcacattttatttctc

SEQ ID NO: 2298 - DNA, 23 bp, Artificial Sequence
  gRNA target sequence
ccaacatactcggattctaccct

SEQ ID NO: 2299 - DNA, 23 bp, Artificial Sequence
  gRNA target sequence
ccctagcatcacacaccgcacaa

SEQ ID NO: 2300 - DNA, 23 bp, Artificial Sequence
  gRNA target sequence
cctagcatcacacaccgcacaat

SEQ ID NO: 2301 - DNA, 23 bp, Artificial Sequence
  gRNA target sequence
ccgcacaatcccctatctaggcc

SEQ ID NO: 2302 - DNA, 23 bp, Artificial Sequence
  gRNA target sequence
cccctatctaggccttcttacga

SEQ ID NO: 2303 - DNA, 23 bp, Artificial Sequence
  gRNA target sequence
ccctatctaggccttcttacgag

SEQ ID NO: 2304 - DNA, 23 bp, Artificial Sequence
  gRNA target sequence
cctatctaggccttcttacgagc

SEQ ID NO: 2305 - DNA, 23 bp, Artificial Sequence
  gRNA target sequence
ccttcttacgagccaaaacctgc

SEQ ID NO: 2306 - DNA, 23 bp, Artificial Sequence
  gRNA target sequence
ccaaaacctgcccctactcctcc

SEQ ID NO: 2307 - DNA, 23 bp, Artificial Sequence
  gRNA target sequence
cctgcccctactcctcctagacc

SEQ ID NO: 2308 - DNA, 23 bp, Artificial Sequence
  gRNA target sequence
cccctactcctcctagacctaac

SEQ ID NO: 2309 - DNA, 23 bp, Artificial Sequence
  gRNA target sequence
ccctactcctcctagacctaacc

SEQ ID NO: 2310 - DNA, 23 bp, Artificial Sequence
  gRNA target sequence
cctactcctcctagacctaacct

SEQ ID NO: 2311 - DNA, 23 bp, Artificial Sequence
  gRNA target sequence
cctcctagacctaacctgactag

SEQ ID NO: 2312 - DNA, 23 bp, Artificial Sequence
  gRNA target sequence
cctagacctaacctgactagaaa

SEQ ID NO: 2313 - DNA, 23 bp, Artificial Sequence
  gRNA target sequence
cctaacctgactagaaaagctat

SEQ ID NO: 2314 - DNA, 23 bp, Artificial Sequence
  gRNA target sequence
cctgactagaaaagctattacct

SEQ ID NO: 2315 - DNA, 23 bp, Artificial Sequence
  gRNA target sequence
cctaaaacaatttcacagcacca

SEQ ID NO: 2316 - DNA, 23 bp, Artificial Sequence
  gRNA target sequence
ccaaatctccacctccatcatca

SEQ ID NO: 2317 - DNA, 23 bp, Artificial Sequence
  gRNA target sequence
ccacctccatcatcacctcaacc

SEQ ID NO: 2318 - DNA, 23 bp, Artificial Sequence
  gRNA target sequence
cctccatcatcacctcaacccaa

SEQ ID NO: 2319 - DNA, 23 bp, Artificial Sequence
  gRNA target sequence
ccatcatcacctcaacccaaaaa

SEQ ID NO: 2320 - DNA, 23 bp, Artificial Sequence
  gRNA target sequence
cctcaacccaaaaaggcataatt

SEQ ID NO: 2321 - DNA, 23 bp, Artificial Sequence
  gRNA target sequence
cccaaaaaggcataattaaactt

SEQ ID NO: 2322 - DNA, 23 bp, Artificial Sequence
  gRNA target sequence
ccaaaaaggcataattaaacttt

SEQ ID NO: 2323 - DNA, 23 bp, Artificial Sequence
  gRNA target sequence
cctctctttcttcttcccactca

SEQ ID NO: 2324 - DNA, 23 bp, Artificial Sequence
  gRNA target sequence
cccactcatcctaaccctactcc

SEQ ID NO: 2325 - DNA, 23 bp, Artificial Sequence
  gRNA target sequence
ccactcatcctaaccctactcct

SEQ ID NO: 2326 - DNA, 23 bp, Artificial Sequence
  gRNA target sequence
cctaaccctactcctaatcacat

SEQ ID NO: 2327 - DNA, 23 bp, Artificial Sequence
  gRNA target sequence
ccctactcctaatcacataacct

SEQ ID NO: 2328 - DNA, 23 bp, Artificial Sequence
  gRNA target sequence
cctactcctaatcacataaccta

SEQ ID NO: 2329 - DNA, 23 bp, Artificial Sequence
  gRNA target sequence
cctaatcacataacctattcccc

SEQ ID NO: 2330 - DNA, 23 bp, Artificial Sequence
  gRNA target sequence
cctattcccccgagcaatctcaa

SEQ ID NO: 2331 - DNA, 23 bp, Artificial Sequence
  gRNA target sequence
cccccgagcaatctcaattacaa

SEQ ID NO: 2332 - DNA, 23 bp, Artificial Sequence
  gRNA target sequence
ccccgagcaatctcaattacaat

SEQ ID NO: 2333 - DNA, 23 bp, Artificial Sequence
  gRNA target sequence
cccgagcaatctcaattacaata

SEQ ID NO: 2334 - DNA, 23 bp, Artificial Sequence
  gRNA target sequence
ccgagcaatctcaattacaatat

SEQ ID NO: 2335 - DNA, 23 bp, Artificial Sequence
  gRNA target sequence
ccaacaaacaatgttcaaccagt

SEQ ID NO: 2336 - DNA, 23 bp, Artificial Sequence
  gRNA target sequence
ccagtaactactactaatcaacg

SEQ ID NO: 2337 - DNA, 23 bp, Artificial Sequence
  gRNA target sequence
cccataatcatacaaagcccccg

SEQ ID NO: 2338 - DNA, 23 bp, Artificial Sequence
  gRNA target sequence
ccataatcatacaaagcccccgc

SEQ ID NO: 2339 - DNA, 23 bp, Artificial Sequence
  gRNA target sequence
cccccgcaccaataggatcctcc

SEQ ID NO: 2340 - DNA, 23 bp, Artificial Sequence
  gRNA target sequence
ccccgcaccaataggatcctccc

SEQ ID NO: 2341 - DNA, 23 bp, Artificial Sequence
  gRNA target sequence
cccgcaccaataggatcctcccg

SEQ ID NO: 2342 - DNA, 23 bp, Artificial Sequence
  gRNA target sequence
ccgcaccaataggatcctcccga

SEQ ID NO: 2343 - DNA, 23 bp, Artificial Sequence
  gRNA target sequence
ccaataggatcctcccgaatcaa

SEQ ID NO: 2344 - DNA, 23 bp, Artificial Sequence
  gRNA target sequence
cctcccgaatcaaccctgacccc

SEQ ID NO: 2345 - DNA, 23 bp, Artificial Sequence
  gRNA target sequence
cccgaatcaaccctgacccctct

SEQ ID NO: 2346 - DNA, 23 bp, Artificial Sequence
  gRNA target sequence
ccgaatcaaccctgacccctctc

SEQ ID NO: 2347 - DNA, 23 bp, Artificial Sequence
  gRNA target sequence
ccctgacccctctccttcataaa

SEQ ID NO: 2348 - DNA, 23 bp, Artificial Sequence
  gRNA target sequence
cctgacccctctccttcataaat

SEQ ID NO: 2349 - DNA, 23 bp, Artificial Sequence
  gRNA target sequence
cccctctccttcataaattattc

SEQ ID NO: 2350 - DNA, 23 bp, Artificial Sequence
  gRNA target sequence
ccctctccttcataaattattca

SEQ ID NO: 2351 - DNA, 23 bp, Artificial Sequence
  gRNA target sequence
cctctccttcataaattattcag

SEQ ID NO: 2352 - DNA, 23 bp, Artificial Sequence
  gRNA target sequence
ccttcataaattattcagcttcc

SEQ ID NO: 2353 - DNA, 23 bp, Artificial Sequence
  gRNA target sequence
cctacactattaaagtttaccac

SEQ ID NO: 2354 - DNA, 23 bp, Artificial Sequence
  gRNA target sequence
ccacaaccaccaccccatcatac

SEQ ID NO: 2355 - DNA, 23 bp, Artificial Sequence
  gRNA target sequence
ccaccaccccatcatactctttc

SEQ ID NO: 2356 - DNA, 23 bp, Artificial Sequence
  gRNA target sequence
ccaccccatcatactctttcacc

SEQ ID NO: 2357 - DNA, 23 bp, Artificial Sequence
  gRNA target sequence
ccccatcatactctttcacccac

SEQ ID NO: 2358 - DNA, 23 bp, Artificial Sequence
  gRNA target sequence
cccatcatactctttcacccaca

SEQ ID NO: 2359 - DNA, 23 bp, Artificial Sequence
  gRNA target sequence
ccatcatactctttcacccacag

SEQ ID NO: 2360 - DNA, 23 bp, Artificial Sequence
  gRNA target sequence
cccacagcaccaatcctacctcc

SEQ ID NO: 2361 - DNA, 23 bp, Artificial Sequence
  gRNA target sequence
ccacagcaccaatcctacctcca

SEQ ID NO: 2362 - DNA, 23 bp, Artificial Sequence
  gRNA target sequence
ccaatcctacctccatcgctaac

SEQ ID NO: 2363 - DNA, 23 bp, Artificial Sequence
  gRNA target sequence
cctacctccatcgctaaccccac

SEQ ID NO: 2364 - DNA, 23 bp, Artificial Sequence
  gRNA target sequence
cctccatcgctaaccccactaaa

SEQ ID NO: 2365 - DNA, 23 bp, Artificial Sequence
  gRNA target sequence
ccatcgctaaccccactaaaaca

SEQ ID NO: 2366 - DNA, 23 bp, Artificial Sequence
  gRNA target sequence
ccccactaaaacactcaccaaga

SEQ ID NO: 2367 - DNA, 23 bp, Artificial Sequence
  gRNA target sequence
cccactaaaacactcaccaagac

SEQ ID NO: 2368 - DNA, 23 bp, Artificial Sequence
  gRNA target sequence
ccactaaaacactcaccaagacc

SEQ ID NO: 2369 - DNA, 23 bp, Artificial Sequence
  gRNA target sequence
ccaagacctcaacccctgacccc

SEQ ID NO: 2370 - DNA, 23 bp, Artificial Sequence
  gRNA target sequence
cctcaacccctgacccccatgcc

SEQ ID NO: 2371 - DNA, 23 bp, Artificial Sequence
  gRNA target sequence
cccctgacccccatgcctcagga

SEQ ID NO: 2372 - DNA, 23 bp, Artificial Sequence
  gRNA target sequence
ccctgacccccatgcctcaggat

SEQ ID NO: 2373 - DNA, 23 bp, Artificial Sequence
  gRNA target sequence
cctgacccccatgcctcaggata

SEQ ID NO: 2374 - DNA, 23 bp, Artificial Sequence
  gRNA target sequence
cccccatgcctcaggatactcct

SEQ ID NO: 2375 - DNA, 23 bp, Artificial Sequence
  gRNA target sequence
ccccatgcctcaggatactcctc

SEQ ID NO: 2376 - DNA, 23 bp, Artificial Sequence
  gRNA target sequence
cccatgcctcaggatactcctca

SEQ ID NO: 2377 - DNA, 23 bp, Artificial Sequence
  gRNA target sequence
ccatgcctcaggatactcctcaa

SEQ ID NO: 2378 - DNA, 23 bp, Artificial Sequence
  gRNA target sequence
cctcaggatactcctcaatagcc

SEQ ID NO: 2379 - DNA, 23 bp, Artificial Sequence
  gRNA target sequence
cctcaatagccatcgctgtagta

SEQ ID NO: 2380 - DNA, 23 bp, Artificial Sequence
  gRNA target sequence
ccatcgctgtagtatatccaaag

SEQ ID NO: 2381 - DNA, 23 bp, Artificial Sequence
  gRNA target sequence
ccaaagacaaccatcattccccc

SEQ ID NO: 2382 - DNA, 23 bp, Artificial Sequence
  gRNA target sequence
ccatcattccccctaaataaatt

SEQ ID NO: 2383 - DNA, 23 bp, Artificial Sequence
  gRNA target sequence
ccccctaaataaattaaaaaaac

SEQ ID NO: 2384 - DNA, 23 bp, Artificial Sequence
  gRNA target sequence
cccctaaataaattaaaaaaact

SEQ ID NO: 2385 - DNA, 23 bp, Artificial Sequence
  gRNA target sequence
ccctaaataaattaaaaaaacta

SEQ ID NO: 2386 - DNA, 23 bp, Artificial Sequence
  gRNA target sequence
cctaaataaattaaaaaaactat

SEQ ID NO: 2387 - DNA, 23 bp, Artificial Sequence
  gRNA target sequence
cccatataacctcccccaaaatt

SEQ ID NO: 2388 - DNA, 23 bp, Artificial Sequence
  gRNA target sequence
ccatataacctcccccaaaattc

SEQ ID NO: 2389 - DNA, 23 bp, Artificial Sequence
  gRNA target sequence
cctcccccaaaattcagaataat

SEQ ID NO: 2390 - DNA, 23 bp, Artificial Sequence
  gRNA target sequence
cccccaaaattcagaataataac

SEQ ID NO: 2391 - DNA, 23 bp, Artificial Sequence
  gRNA target sequence
ccccaaaattcagaataataaca

SEQ ID NO: 2392 - DNA, 23 bp, Artificial Sequence
  gRNA target sequence
cccaaaattcagaataataacac

SEQ ID NO: 2393 - DNA, 23 bp, Artificial Sequence
  gRNA target sequence
ccaaaattcagaataataacaca

SEQ ID NO: 2394 - DNA, 23 bp, Artificial Sequence
  gRNA target sequence
cccgaccacaccgctaacaatca

SEQ ID NO: 2395 - DNA, 23 bp, Artificial Sequence
  gRNA target sequence
ccgaccacaccgctaacaatcaa

SEQ ID NO: 2396 - DNA, 23 bp, Artificial Sequence
  gRNA target sequence
ccacaccgctaacaatcaatact

SEQ ID NO: 2397 - DNA, 23 bp, Artificial Sequence
  gRNA target sequence
ccgctaacaatcaatactaaacc

SEQ ID NO: 2398 - DNA, 23 bp, Artificial Sequence
  gRNA target sequence
cccccataaataggagaaggctt

SEQ ID NO: 2399 - DNA, 23 bp, Artificial Sequence
  gRNA target sequence
ccccataaataggagaaggctta

SEQ ID NO: 2400 - DNA, 23 bp, Artificial Sequence
  gRNA target sequence
cccataaataggagaaggcttag

SEQ ID NO: 2401 - DNA, 23 bp, Artificial Sequence
  gRNA target sequence
ccataaataggagaaggcttaga

SEQ ID NO: 2402 - DNA, 23 bp, Artificial Sequence
  gRNA target sequence
ccccacaaaccccattactaaac

SEQ ID NO: 2403 - DNA, 23 bp, Artificial Sequence
  gRNA target sequence
cccacaaaccccattactaaacc

SEQ ID NO: 2404 - DNA, 23 bp, Artificial Sequence
  gRNA target sequence
ccacaaaccccattactaaaccc

SEQ ID NO: 2405 - DNA, 23 bp, Artificial Sequence
  gRNA target sequence
ccccattactaaacccacactca

SEQ ID NO: 2406 - DNA, 23 bp, Artificial Sequence
  gRNA target sequence
cccattactaaacccacactcaa

SEQ ID NO: 2407 - DNA, 23 bp, Artificial Sequence
  gRNA target sequence
ccattactaaacccacactcaac

SEQ ID NO: 2408 - DNA, 23 bp, Artificial Sequence
  gRNA target sequence
cccacactcaacagaaacaaagc

SEQ ID NO: 2409 - DNA, 23 bp, Artificial Sequence
  gRNA target sequence
ccacactcaacagaaacaaagca

SEQ ID NO: 2410 - DNA, 23 bp, Artificial Sequence
  gRNA target sequence
ccacgaccaatgatatgaaaaac

SEQ ID NO: 2411 - DNA, 23 bp, Artificial Sequence
  gRNA target sequence
ccaatgatatgaaaaaccatcgt

SEQ ID NO: 2412 - DNA, 23 bp, Artificial Sequence
  gRNA target sequence
ccatcgttgtatttcaactacaa

SEQ ID NO: 2413 - DNA, 23 bp, Artificial Sequence
  gRNA target sequence
ccaatgaccccaatacgcaaaac

SEQ ID NO: 2414 - DNA, 23 bp, Artificial Sequence
  gRNA target sequence
ccccaatacgcaaaactaacccc

SEQ ID NO: 2415 - DNA, 23 bp, Artificial Sequence
  gRNA target sequence
cccaatacgcaaaactaaccccc

SEQ ID NO: 2416 - DNA, 23 bp, Artificial Sequence
  gRNA target sequence
ccaatacgcaaaactaaccccct

SEQ ID NO: 2417 - DNA, 23 bp, Artificial Sequence
  gRNA target sequence
ccccctaataaaattaattaacc

SEQ ID NO: 2418 - DNA, 23 bp, Artificial Sequence
  gRNA target sequence
cccctaataaaattaattaacca

SEQ ID NO: 2419 - DNA, 23 bp, Artificial Sequence
  gRNA target sequence
ccctaataaaattaattaaccac

SEQ ID NO: 2420 - DNA, 23 bp, Artificial Sequence
  gRNA target sequence
cctaataaaattaattaaccact

SEQ ID NO: 2421 - DNA, 23 bp, Artificial Sequence
  gRNA target sequence
ccactcattcatcgacctcccca

SEQ ID NO: 2422 - DNA, 23 bp, Artificial Sequence
  gRNA target sequence
cctccccaccccatccaacatct

SEQ ID NO: 2423 - DNA, 23 bp, Artificial Sequence
  gRNA target sequence
ccccaccccatccaacatctccg

SEQ ID NO: 2424 - DNA, 23 bp, Artificial Sequence
  gRNA target sequence
cccaccccatccaacatctccgc

SEQ ID NO: 2425 - DNA, 23 bp, Artificial Sequence
  gRNA target sequence
ccaccccatccaacatctccgca

SEQ ID NO: 2426 - DNA, 23 bp, Artificial Sequence
  gRNA target sequence
ccccatccaacatctccgcatga

SEQ ID NO: 2427 - DNA, 23 bp, Artificial Sequence
  gRNA target sequence
cccatccaacatctccgcatgat

SEQ ID NO: 2428 - DNA, 23 bp, Artificial Sequence
  gRNA target sequence
ccatccaacatctccgcatgatg

SEQ ID NO: 2429 - DNA, 23 bp, Artificial Sequence
  gRNA target sequence
ccaacatctccgcatgatgaaac

SEQ ID NO: 2430 - DNA, 23 bp, Artificial Sequence
  gRNA target sequence
ccgcatgatgaaacttcggctca

SEQ ID NO: 2431 - DNA, 23 bp, Artificial Sequence
  gRNA target sequence
ccttggcgcctgcctgatcctcc

SEQ ID NO: 2432 - DNA, 23 bp, Artificial Sequence
  gRNA target sequence
cctgcctgatcctccaaatcacc

SEQ ID NO: 2433 - DNA, 23 bp, Artificial Sequence
  gRNA target sequence
cctgatcctccaaatcaccacag

SEQ ID NO: 2434 - DNA, 23 bp, Artificial Sequence
  gRNA target sequence
cctccaaatcaccacaggactat

SEQ ID NO: 2435 - DNA, 23 bp, Artificial Sequence
  gRNA target sequence
ccaaatcaccacaggactattcc

SEQ ID NO: 2436 - DNA, 23 bp, Artificial Sequence
  gRNA target sequence
ccacaggactattcctagccatg

SEQ ID NO: 2437 - DNA, 23 bp, Artificial Sequence
  gRNA target sequence
cctagccatgcactactcaccag

SEQ ID NO: 2438 - DNA, 23 bp, Artificial Sequence
  gRNA target sequence
ccatgcactactcaccagacgcc

SEQ ID NO: 2439 - DNA, 23 bp, Artificial Sequence
  gRNA target sequence
ccagacgcctcaaccgccttttc

SEQ ID NO: 2440 - DNA, 23 bp, Artificial Sequence
  gRNA target sequence
cctcaaccgccttttcatcaatc

SEQ ID NO: 2441 - DNA, 23 bp, Artificial Sequence
  gRNA target sequence
ccgccttttcatcaatcgcccac

SEQ ID NO: 2442 - DNA, 23 bp, Artificial Sequence
  gRNA target sequence
ccttttcatcaatcgcccacatc

SEQ ID NO: 2443 - DNA, 23 bp, Artificial Sequence
  gRNA target sequence
cccacatcactcgagacgtaaat

SEQ ID NO: 2444 - DNA, 23 bp, Artificial Sequence
  gRNA target sequence
ccacatcactcgagacgtaaatt

SEQ ID NO: 2445 - DNA, 23 bp, Artificial Sequence
  gRNA target sequence
ccgctaccttcacgccaatggcg

SEQ ID NO: 2446 - DNA, 23 bp, Artificial Sequence
  gRNA target sequence
ccttcacgccaatggcgcctcaa

SEQ ID NO: 2447 - DNA, 23 bp, Artificial Sequence
  gRNA target sequence
ccaatggcgcctcaatattcttt

SEQ ID NO: 2448 - DNA, 23 bp, Artificial Sequence
  gRNA target sequence
cctcaatattctttatctgcctc

SEQ ID NO: 2449 - DNA, 23 bp, Artificial Sequence
  gRNA target sequence
cctcttcctacacatcgggcgag

SEQ ID NO: 2450 - DNA, 23 bp, Artificial Sequence
  gRNA target sequence
cctacacatcgggcgaggcctat

SEQ ID NO: 2451 - DNA, 23 bp, Artificial Sequence
  gRNA target sequence
cctatattacggatcatttctct

SEQ ID NO: 2452 - DNA, 23 bp, Artificial Sequence
  gRNA target sequence
cctgaaacatcggcattatcctc

SEQ ID NO: 2453 - DNA, 23 bp, Artificial Sequence
  gRNA target sequence
cctcctgcttgcaactatagcaa

SEQ ID NO: 2454 - DNA, 23 bp, Artificial Sequence
  gRNA target sequence
cctgcttgcaactatagcaacag

SEQ ID NO: 2455 - DNA, 23 bp, Artificial Sequence
  gRNA target sequence
ccttcataggctatgtcctcccg

SEQ ID NO: 2456 - DNA, 23 bp, Artificial Sequence
  gRNA target sequence
cctcccgtgaggccaaatatcat

SEQ ID NO: 2457 - DNA, 23 bp, Artificial Sequence
  gRNA target sequence
cccgtgaggccaaatatcattct

SEQ ID NO: 2458 - DNA, 23 bp, Artificial Sequence
  gRNA target sequence
ccgtgaggccaaatatcattctg

SEQ ID NO: 2459 - DNA, 23 bp, Artificial Sequence
  gRNA target sequence
ccaaatatcattctgaggggcca

SEQ ID NO: 2460 - DNA, 23 bp, Artificial Sequence
  gRNA target sequence
ccacagtaattacaaacttacta

SEQ ID NO: 2461 - DNA, 23 bp, Artificial Sequence
  gRNA target sequence
ccgccatcccatacattgggaca

SEQ ID NO: 2462 - DNA, 23 bp, Artificial Sequence
  gRNA target sequence
ccatcccatacattgggacagac

SEQ ID NO: 2463 - DNA, 23 bp, Artificial Sequence
  gRNA target sequence
cccatacattgggacagacctag

SEQ ID NO: 2464 - DNA, 23 bp, Artificial Sequence
  gRNA target sequence
ccatacattgggacagacctagt

SEQ ID NO: 2465 - DNA, 23 bp, Artificial Sequence
  gRNA target sequence
cctagttcaatgaatctgaggag

SEQ ID NO: 2466 - DNA, 23 bp, Artificial Sequence
  gRNA target sequence
cccaccctcacacgattctttac

SEQ ID NO: 2467 - DNA, 23 bp, Artificial Sequence
  gRNA target sequence
ccaccctcacacgattctttacc

SEQ ID NO: 2468 - DNA, 23 bp, Artificial Sequence
  gRNA target sequence
ccctcacacgattctttaccttt

SEQ ID NO: 2469 - DNA, 23 bp, Artificial Sequence
  gRNA target sequence
cctcacacgattctttacctttc

SEQ ID NO: 2470 - DNA, 23 bp, Artificial Sequence
  gRNA target sequence
cctttcacttcatcttgcccttc

SEQ ID NO: 2471 - DNA, 23 bp, Artificial Sequence
  gRNA target sequence
cccttcattattgcagccctagc

SEQ ID NO: 2472 - DNA, 23 bp, Artificial Sequence
  gRNA target sequence
ccttcattattgcagccctagca

SEQ ID NO: 2473 - DNA, 23 bp, Artificial Sequence
  gRNA target sequence
ccctagcaacactccacctccta

SEQ ID NO: 2474 - DNA, 23 bp, Artificial Sequence
  gRNA target sequence
cctagcaacactccacctcctat

SEQ ID NO: 2475 - DNA, 23 bp, Artificial Sequence
  gRNA target sequence
ccacctcctattcttgcacgaaa

SEQ ID NO: 2476 - DNA, 23 bp, Artificial Sequence
  gRNA target sequence
cctcctattcttgcacgaaacgg

SEQ ID NO: 2477 - DNA, 23 bp, Artificial Sequence
  gRNA target sequence
cctattcttgcacgaaacgggat

SEQ ID NO: 2478 - DNA, 23 bp, Artificial Sequence
  gRNA target sequence
ccccctaggaatcacctcccatt

SEQ ID NO: 2479 - DNA, 23 bp, Artificial Sequence
  gRNA target sequence
cccctaggaatcacctcccattc

SEQ ID NO: 2480 - DNA, 23 bp, Artificial Sequence
  gRNA target sequence
ccctaggaatcacctcccattcc

SEQ ID NO: 2481 - DNA, 23 bp, Artificial Sequence
  gRNA target sequence
cctaggaatcacctcccattccg

SEQ ID NO: 2482 - DNA, 23 bp, Artificial Sequence
  gRNA target sequence
cctcccattccgataaaatcacc

SEQ ID NO: 2483 - DNA, 23 bp, Artificial Sequence
  gRNA target sequence
cccattccgataaaatcaccttc

SEQ ID NO: 2484 - DNA, 23 bp, Artificial Sequence
  gRNA target sequence
ccattccgataaaatcaccttcc

SEQ ID NO: 2485 - DNA, 23 bp, Artificial Sequence
  gRNA target sequence
ccgataaaatcaccttccaccct

SEQ ID NO: 2486 - DNA, 23 bp, Artificial Sequence
  gRNA target sequence
ccttccacccttactacacaatc

SEQ ID NO: 2487 - DNA, 23 bp, Artificial Sequence
  gRNA target sequence
ccacccttactacacaatcaaag

SEQ ID NO: 2488 - DNA, 23 bp, Artificial Sequence
  gRNA target sequence
cccttactacacaatcaaagacg

SEQ ID NO: 2489 - DNA, 23 bp, Artificial Sequence
  gRNA target sequence
ccttactacacaatcaaagacgc

SEQ ID NO: 2490 - DNA, 23 bp, Artificial Sequence
  gRNA target sequence
ccctcggcttacttctcttcctt

SEQ ID NO: 2491 - DNA, 23 bp, Artificial Sequence
  gRNA target sequence
cctcggcttacttctcttccttc

SEQ ID NO: 2492 - DNA, 23 bp, Artificial Sequence
  gRNA target sequence
ccttctctccttaatgacattaa

SEQ ID NO: 2493 - DNA, 23 bp, Artificial Sequence
  gRNA target sequence
ccttaatgacattaacactattc

SEQ ID NO: 2494 - DNA, 23 bp, Artificial Sequence
  gRNA target sequence
ccagacctcctaggcgacccaga

SEQ ID NO: 2495 - DNA, 23 bp, Artificial Sequence
  gRNA target sequence
cctcctaggcgacccagacaatt

SEQ ID NO: 2496 - DNA, 23 bp, Artificial Sequence
  gRNA target sequence
cctaggcgacccagacaattata

SEQ ID NO: 2497 - DNA, 23 bp, Artificial Sequence
  gRNA target sequence
cccagacaattataccctagcca

SEQ ID NO: 2498 - DNA, 23 bp, Artificial Sequence
  gRNA target sequence
ccagacaattataccctagccaa

SEQ ID NO: 2499 - DNA, 23 bp, Artificial Sequence
  gRNA target sequence
ccctagccaaccccttaaacacc

SEQ ID NO: 2500 - DNA, 23 bp, Artificial Sequence
  gRNA target sequence
cctagccaaccccttaaacaccc

SEQ ID NO: 2501 - DNA, 23 bp, Artificial Sequence
  gRNA target sequence
ccaaccccttaaacacccctccc

SEQ ID NO: 2502 - DNA, 23 bp, Artificial Sequence
  gRNA target sequence
ccccttaaacacccctccccaca

SEQ ID NO: 2503 - DNA, 23 bp, Artificial Sequence
  gRNA target sequence
cccttaaacacccctccccacat

SEQ ID NO: 2504 - DNA, 23 bp, Artificial Sequence
  gRNA target sequence
ccttaaacacccctccccacatc

SEQ ID NO: 2505 - DNA, 23 bp, Artificial Sequence
  gRNA target sequence
cccctccccacatcaagcccgaa

SEQ ID NO: 2506 - DNA, 23 bp, Artificial Sequence
  gRNA target sequence
ccctccccacatcaagcccgaat

SEQ ID NO: 2507 - DNA, 23 bp, Artificial Sequence
  gRNA target sequence
cctccccacatcaagcccgaatg

SEQ ID NO: 2508 - DNA, 23 bp, Artificial Sequence
  gRNA target sequence
ccccacatcaagcccgaatgata

SEQ ID NO: 2509 - DNA, 23 bp, Artificial Sequence
  gRNA target sequence
cccacatcaagcccgaatgatat

SEQ ID NO: 2510 - DNA, 23 bp, Artificial Sequence
  gRNA target sequence
ccacatcaagcccgaatgatatt

SEQ ID NO: 2511 - DNA, 23 bp, Artificial Sequence
  gRNA target sequence
cccgaatgatatttcctattcgc

SEQ ID NO: 2512 - DNA, 23 bp, Artificial Sequence
  gRNA target sequence
ccgaatgatatttcctattcgcc

SEQ ID NO: 2513 - DNA, 23 bp, Artificial Sequence
  gRNA target sequence
cctattcgcctacacaattctcc

SEQ ID NO: 2514 - DNA, 23 bp, Artificial Sequence
  gRNA target sequence
cctacacaattctccgatccgtc

SEQ ID NO: 2515 - DNA, 23 bp, Artificial Sequence
  gRNA target sequence
ccgatccgtccctaacaaactag

SEQ ID NO: 2516 - DNA, 23 bp, Artificial Sequence
  gRNA target sequence
ccgtccctaacaaactaggaggc

SEQ ID NO: 2517 - DNA, 23 bp, Artificial Sequence
  gRNA target sequence
ccctaacaaactaggaggcgtcc

SEQ ID NO: 2518 - DNA, 23 bp, Artificial Sequence
  gRNA target sequence
cctaacaaactaggaggcgtcct

SEQ ID NO: 2519 - DNA, 23 bp, Artificial Sequence
  gRNA target sequence
ccttgccctattactatccatcc

SEQ ID NO: 2520 - DNA, 23 bp, Artificial Sequence
  gRNA target sequence
ccctattactatccatcctcatc

SEQ ID NO: 2521 - DNA, 23 bp, Artificial Sequence
  gRNA target sequence
cctattactatccatcctcatcc

SEQ ID NO: 2522 - DNA, 23 bp, Artificial Sequence
  gRNA target sequence
ccatcctcatcctagcaataatc

SEQ ID NO: 2523 - DNA, 23 bp, Artificial Sequence
  gRNA target sequence
cctcatcctagcaataatcccca

SEQ ID NO: 2524 - DNA, 23 bp, Artificial Sequence
  gRNA target sequence
cctagcaataatccccatcctcc

SEQ ID NO: 2525 - DNA, 23 bp, Artificial Sequence
  gRNA target sequence
ccccatcctccatatatccaaac

SEQ ID NO: 2526 - DNA, 23 bp, Artificial Sequence
  gRNA target sequence
cccatcctccatatatccaaaca

SEQ ID NO: 2527 - DNA, 23 bp, Artificial Sequence
  gRNA target sequence
ccatcctccatatatccaaacaa

SEQ ID NO: 2528 - DNA, 23 bp, Artificial Sequence
  gRNA target sequence
cctccatatatccaaacaacaaa

SEQ ID NO: 2529 - DNA, 23 bp, Artificial Sequence
  gRNA target sequence
ccatatatccaaacaacaaagca

SEQ ID NO: 2530 - DNA, 23 bp, Artificial Sequence
  gRNA target sequence
ccaaacaacaaagcataatattt

SEQ ID NO: 2531 - DNA, 23 bp, Artificial Sequence
  gRNA target sequence
cccactaagccaatcactttatt

SEQ ID NO: 2532 - DNA, 23 bp, Artificial Sequence
  gRNA target sequence
ccactaagccaatcactttattg

SEQ ID NO: 2533 - DNA, 23 bp, Artificial Sequence
  gRNA target sequence
ccaatcactttattgactcctag

SEQ ID NO: 2534 - DNA, 23 bp, Artificial Sequence
  gRNA target sequence
cctagccgcagacctcctcattc

SEQ ID NO: 2535 - DNA, 23 bp, Artificial Sequence
  gRNA target sequence
ccgcagacctcctcattctaacc

SEQ ID NO: 2536 - DNA, 23 bp, Artificial Sequence
  gRNA target sequence
cctcctcattctaacctgaatcg

SEQ ID NO: 2537 - DNA, 23 bp, Artificial Sequence
  gRNA target sequence
cctcattctaacctgaatcggag

SEQ ID NO: 2538 - DNA, 23 bp, Artificial Sequence
  gRNA target sequence
cctgaatcggaggacaaccagta

SEQ ID NO: 2539 - DNA, 23 bp, Artificial Sequence
  gRNA target sequence
ccagtaagctacccttttaccat

SEQ ID NO: 2540 - DNA, 23 bp, Artificial Sequence
  gRNA target sequence
cccttttaccatcattggacaag

SEQ ID NO: 2541 - DNA, 23 bp, Artificial Sequence
  gRNA target sequence
ccttttaccatcattggacaagt

SEQ ID NO: 2542 - DNA, 23 bp, Artificial Sequence
  gRNA target sequence
ccatcattggacaagtagcatcc

SEQ ID NO: 2543 - DNA, 23 bp, Artificial Sequence
  gRNA target sequence
ccgtactatacttcacaacaatc

SEQ ID NO: 2544 - DNA, 23 bp, Artificial Sequence
  gRNA target sequence
cctaatcctaataccaactatct

SEQ ID NO: 2545 - DNA, 23 bp, Artificial Sequence
  gRNA target sequence
cctaataccaactatctccctaa

SEQ ID NO: 2546 - DNA, 23 bp, Artificial Sequence
  gRNA target sequence
ccaactatctccctaattgaaaa

SEQ ID NO: 2547 - DNA, 23 bp, Artificial Sequence
  gRNA target sequence
ccctaattgaaaacaaaatactc

SEQ ID NO: 2548 - DNA, 23 bp, Artificial Sequence
  gRNA target sequence
cctaattgaaaacaaaatactca

SEQ ID NO: 2549 - DNA, 23 bp, Artificial Sequence
  gRNA target sequence
cctgtccttgtagtataaactaa

SEQ ID NO: 2550 - DNA, 23 bp, Artificial Sequence
  gRNA target sequence
ccttgtagtataaactaatacac

SEQ ID NO: 2551 - DNA, 23 bp, Artificial Sequence
  gRNA target sequence
ccagtcttgtaaaccggagatga

SEQ ID NO: 2552 - DNA, 23 bp, Artificial Sequence
  gRNA target sequence
ccggagatgaaaacctttttcca

SEQ ID NO: 2553 - DNA, 23 bp, Artificial Sequence
  gRNA target sequence
cctttttccaaggacaaatcaga

SEQ ID NO: 2554 - DNA, 23 bp, Artificial Sequence
  gRNA target sequence
ccaaggacaaatcagagaaaaag

SEQ ID NO: 2555 - DNA, 23 bp, Artificial Sequence
  gRNA target sequence
ccaccattagcacccaaagctaa

SEQ ID NO: 2556 - DNA, 23 bp, Artificial Sequence
  gRNA target sequence
ccattagcacccaaagctaagat

SEQ ID NO: 2557 - DNA, 23 bp, Artificial Sequence
  gRNA target sequence
cccaaagctaagattctaattta

SEQ ID NO: 2558 - DNA, 23 bp, Artificial Sequence
  gRNA target sequence
ccaaagctaagattctaatttaa

SEQ ID NO: 2559 - DNA, 23 bp, Artificial Sequence
  gRNA target sequence
ccacccaagtattgactcaccca

SEQ ID NO: 2560 - DNA, 23 bp, Artificial Sequence
  gRNA target sequence
cccaagtattgactcacccatca

SEQ ID NO: 2561 - DNA, 23 bp, Artificial Sequence
  gRNA target sequence
ccaagtattgactcacccatcaa

SEQ ID NO: 2562 - DNA, 23 bp, Artificial Sequence
  gRNA target sequence
cccatcaacaaccgctatgtatt

SEQ ID NO: 2563 - DNA, 23 bp, Artificial Sequence
  gRNA target sequence
ccatcaacaaccgctatgtattt

SEQ ID NO: 2564 - DNA, 23 bp, Artificial Sequence
  gRNA target sequence
ccgctatgtatttcgtacattac

SEQ ID NO: 2565 - DNA, 23 bp, Artificial Sequence
  gRNA target sequence
ccagccaccatgaatattgtacg

SEQ ID NO: 2566 - DNA, 23 bp, Artificial Sequence
  gRNA target sequence
ccaccatgaatattgtacggtac

SEQ ID NO: 2567 - DNA, 23 bp, Artificial Sequence
  gRNA target sequence
ccatgaatattgtacggtaccat

SEQ ID NO: 2568 - DNA, 23 bp, Artificial Sequence
  gRNA target sequence
ccataaatacttgaccacctgta

SEQ ID NO: 2569 - DNA, 23 bp, Artificial Sequence
  gRNA target sequence
ccacctgtagtacataaaaaccc

SEQ ID NO: 2570 - DNA, 23 bp, Artificial Sequence
  gRNA target sequence
cctgtagtacataaaaacccaat

SEQ ID NO: 2571 - DNA, 23 bp, Artificial Sequence
  gRNA target sequence
cccaatccacatcaaaaccccct

SEQ ID NO: 2572 - DNA, 23 bp, Artificial Sequence
  gRNA target sequence
ccaatccacatcaaaaccccctc

SEQ ID NO: 2573 - DNA, 23 bp, Artificial Sequence
  gRNA target sequence
ccacatcaaaaccccctccccat

SEQ ID NO: 2574 - DNA, 23 bp, Artificial Sequence
  gRNA target sequence
ccccctccccatgcttacaagca

SEQ ID NO: 2575 - DNA, 23 bp, Artificial Sequence
  gRNA target sequence
cccctccccatgcttacaagcaa

SEQ ID NO: 2576 - DNA, 23 bp, Artificial Sequence
  gRNA target sequence
ccctccccatgcttacaagcaag

SEQ ID NO: 2577 - DNA, 23 bp, Artificial Sequence
  gRNA target sequence
cctccccatgcttacaagcaagt

SEQ ID NO: 2578 - DNA, 23 bp, Artificial Sequence
  gRNA target sequence
ccccatgcttacaagcaagtaca

SEQ ID NO: 2579 - DNA, 23 bp, Artificial Sequence
  gRNA target sequence
cccatgcttacaagcaagtacag

SEQ ID NO: 2580 - DNA, 23 bp, Artificial Sequence
  gRNA target sequence
ccatgcttacaagcaagtacagc

SEQ ID NO: 2581 - DNA, 23 bp, Artificial Sequence
  gRNA target sequence
ccctcaactatcacacatcaact

SEQ ID NO: 2582 - DNA, 23 bp, Artificial Sequence
  gRNA target sequence
cctcaactatcacacatcaactg

SEQ ID NO: 2583 - DNA, 23 bp, Artificial Sequence
  gRNA target sequence
ccaaagccacccctcacccacta

SEQ ID NO: 2584 - DNA, 23 bp, Artificial Sequence
  gRNA target sequence
ccacccctcacccactaggatac

SEQ ID NO: 2585 - DNA, 23 bp, Artificial Sequence
  gRNA target sequence
cccctcacccactaggataccaa

SEQ ID NO: 2586 - DNA, 23 bp, Artificial Sequence
  gRNA target sequence
ccctcacccactaggataccaac

SEQ ID NO: 2587 - DNA, 23 bp, Artificial Sequence
  gRNA target sequence
cctcacccactaggataccaaca

SEQ ID NO: 2588 - DNA, 23 bp, Artificial Sequence
  gRNA target sequence
cccactaggataccaacaaacct

SEQ ID NO: 2589 - DNA, 23 bp, Artificial Sequence
  gRNA target sequence
ccactaggataccaacaaaccta

SEQ ID NO: 2590 - DNA, 23 bp, Artificial Sequence
  gRNA target sequence
ccaacaaacctacccacccttaa

SEQ ID NO: 2591 - DNA, 23 bp, Artificial Sequence
  gRNA target sequence
cctacccacccttaacagtacat

SEQ ID NO: 2592 - DNA, 23 bp, Artificial Sequence
  gRNA target sequence
cccacccttaacagtacatagta

SEQ ID NO: 2593 - DNA, 23 bp, Artificial Sequence
  gRNA target sequence
ccacccttaacagtacatagtac

SEQ ID NO: 2594 - DNA, 23 bp, Artificial Sequence
  gRNA target sequence
cccttaacagtacatagtacata

SEQ ID NO: 2595 - DNA, 23 bp, Artificial Sequence
  gRNA target sequence
ccttaacagtacatagtacataa

SEQ ID NO: 2596 - DNA, 23 bp, Artificial Sequence
  gRNA target sequence
ccatttaccgtacatagcacatt

SEQ ID NO: 2597 - DNA, 23 bp, Artificial Sequence
  gRNA target sequence
ccgtacatagcacattacagtca

SEQ ID NO: 2598 - DNA, 23 bp, Artificial Sequence
  gRNA target sequence
cccttctcgtccccatggatgac

SEQ ID NO: 2599 - DNA, 23 bp, Artificial Sequence
  gRNA target sequence
ccttctcgtccccatggatgacc

SEQ ID NO: 2600 - DNA, 23 bp, Artificial Sequence
  gRNA target sequence
ccccatggatgacccccctcaga

SEQ ID NO: 2601 - DNA, 23 bp, Artificial Sequence
  gRNA target sequence
cccatggatgacccccctcagat

SEQ ID NO: 2602 - DNA, 23 bp, Artificial Sequence
  gRNA target sequence
ccatggatgacccccctcagata

SEQ ID NO: 2603 - DNA, 23 bp, Artificial Sequence
  gRNA target sequence
cccccctcagataggggtccctt

SEQ ID NO: 2604 - DNA, 23 bp, Artificial Sequence
  gRNA target sequence
ccccctcagataggggtcccttg

SEQ ID NO: 2605 - DNA, 23 bp, Artificial Sequence
  gRNA target sequence
cccctcagataggggtcccttga

SEQ ID NO: 2606 - DNA, 23 bp, Artificial Sequence
  gRNA target sequence
ccctcagataggggtcccttgac

SEQ ID NO: 2607 - DNA, 23 bp, Artificial Sequence
  gRNA target sequence
cctcagataggggtcccttgacc

SEQ ID NO: 2608 - DNA, 23 bp, Artificial Sequence
  gRNA target sequence
cccttgaccaccatcctccgtga

SEQ ID NO: 2609 - DNA, 23 bp, Artificial Sequence
  gRNA target sequence
ccttgaccaccatcctccgtgaa

SEQ ID NO: 2610 - DNA, 23 bp, Artificial Sequence
  gRNA target sequence
ccaccatcctccgtgaaatcaat

SEQ ID NO: 2611 - DNA, 23 bp, Artificial Sequence
  gRNA target sequence
ccatcctccgtgaaatcaatatc

SEQ ID NO: 2612 - DNA, 23 bp, Artificial Sequence
  gRNA target sequence
cctccgtgaaatcaatatcccgc

SEQ ID NO: 2613 - DNA, 23 bp, Artificial Sequence
  gRNA target sequence
ccgtgaaatcaatatcccgcaca

SEQ ID NO: 2614 - DNA, 23 bp, Artificial Sequence
  gRNA target sequence
cccgcacaagagtgctactctcc

SEQ ID NO: 2615 - DNA, 23 bp, Artificial Sequence
  gRNA target sequence
ccgcacaagagtgctactctcct

SEQ ID NO: 2616 - DNA, 23 bp, Artificial Sequence
  gRNA target sequence
cctcgctccgggcccataacact

SEQ ID NO: 2617 - DNA, 23 bp, Artificial Sequence
  gRNA target sequence
ccgggcccataacacttgggggt

SEQ ID NO: 2618 - DNA, 23 bp, Artificial Sequence
  gRNA target sequence
cccataacacttgggggtagcta

SEQ ID NO: 2619 - DNA, 23 bp, Artificial Sequence
  gRNA target sequence
ccataacacttgggggtagctaa

SEQ ID NO: 2620 - DNA, 23 bp, Artificial Sequence
  gRNA target sequence
ccgacatctggttcctacttcag

SEQ ID NO: 2621 - DNA, 23 bp, Artificial Sequence
  gRNA target sequence
cctacttcagggtcataaagcct

SEQ ID NO: 2622 - DNA, 23 bp, Artificial Sequence
  gRNA target sequence
cctaaatagcccacacgttcccc

SEQ ID NO: 2623 - DNA, 23 bp, Artificial Sequence
  gRNA target sequence
cccacacgttccccttaaataag

SEQ ID NO: 2624 - DNA, 23 bp, Artificial Sequence
  gRNA target sequence
ccacacgttccccttaaataaga

SEQ ID NO: 2625 - DNA, 23 bp, Artificial Sequence
  gRNA target sequence
ccccttaaataagacatcacgat

SEQ ID NO: 2626 - DNA, 23 bp, Artificial Sequence
  gRNA target sequence
cccttaaataagacatcacgatg

SEQ ID NO: 2627 - DNA, 23 bp, Artificial Sequence
  gRNA target sequence
ccttaaataagacatcacgatgg

SEQ ID NO: 2628 - DNA, 20 bp, Artificial Sequence
  gRNA target sequence
gctcccgtgagtggttaata

SEQ ID NO: 2629 - DNA, 20 bp, Artificial Sequence
  gRNA target sequence
agctcccgtgagtggttaat

SEQ ID NO: 2630 - DNA, 20 bp, Artificial Sequence
  gRNA target sequence
gcatggagagctcccgtgag

SEQ ID NO: 2631 - DNA, 20 bp, Artificial Sequence
  gRNA target sequence
agacgaaaataccaaatgca

SEQ ID NO: 2632 - DNA, 20 bp, Artificial Sequence
  gRNA target sequence
tactgcgacatagggtgctc

SEQ ID NO: 2633 - DNA, 20 bp, Artificial Sequence
  gRNA target sequence
aagacagatactgcgacata

SEQ ID NO: 2634 - DNA, 20 bp, Artificial Sequence
  gRNA target sequence
aaagacagatactgcgacat

SEQ ID NO: 2635 - DNA, 20 bp, Artificial Sequence
  gRNA target sequence
gataaataataggatgaggc

SEQ ID NO: 2636 - DNA, 20 bp, Artificial Sequence
  gRNA target sequence
gtgcgataaataataggatg

SEQ ID NO: 2637 - DNA, 20 bp, Artificial Sequence
  gRNA target sequence
acgtaggtgcgataaataat

SEQ ID NO: 2638 - DNA, 20 bp, Artificial Sequence
  gRNA target sequence
tcgcctgtaatattgaacgt

SEQ ID NO: 2639 - DNA, 20 bp, Artificial Sequence
  gRNA target sequence
tatgatgtctgtgtggaaag

SEQ ID NO: 2640 - DNA, 20 bp, Artificial Sequence
  gRNA target sequence
tttttgttatgatgtctgtg

SEQ ID NO: 2641 - DNA, 20 bp, Artificial Sequence
  gRNA target sequence
gaagcgggggagggggggtt

SEQ ID NO: 2642 - DNA, 20 bp, Artificial Sequence
  gRNA target sequence
tggccagaagcgggggaggg

SEQ ID NO: 2643 - DNA, 20 bp, Artificial Sequence
  gRNA target sequence
gtggccagaagcgggggagg

SEQ ID NO: 2644 - DNA, 20 bp, Artificial Sequence
  gRNA target sequence
tgtggccagaagcgggggag

SEQ ID NO: 2645 - DNA, 20 bp, Artificial Sequence
  gRNA target sequence
ctgtggccagaagcggggga

SEQ ID NO: 2646 - DNA, 20 bp, Artificial Sequence
  gRNA target sequence
gctgtggccagaagcggggg

SEQ ID NO: 2647 - DNA, 20 bp, Artificial Sequence
  gRNA target sequence
agtgctgtggccagaagcgg

SEQ ID NO: 2648 - DNA, 20 bp, Artificial Sequence
  gRNA target sequence
aagtgctgtggccagaagcg

SEQ ID NO: 2649 - DNA, 20 bp, Artificial Sequence
  gRNA target sequence
taagtgctgtggccagaagc

SEQ ID NO: 2650 - DNA, 20 bp, Artificial Sequence
  gRNA target sequence
ttaagtgctgtggccagaag

SEQ ID NO: 2651 - DNA, 20 bp, Artificial Sequence
  gRNA target sequence
agagatgtgtttaagtgctg

SEQ ID NO: 2652 - DNA, 20 bp, Artificial Sequence
  gRNA target sequence
ggttctttgtttttggggtt

SEQ ID NO: 2653 - DNA, 20 bp, Artificial Sequence
  gRNA target sequence
gttagggttctttgtttttg

SEQ ID NO: 2654 - DNA, 20 bp, Artificial Sequence
  gRNA target sequence
tgttagggttctttgttttt

SEQ ID NO: 2655 - DNA, 20 bp, Artificial Sequence
  gRNA target sequence
gtgttagggttctttgtttt

SEQ ID NO: 2656 - DNA, 20 bp, Artificial Sequence
  gRNA target sequence
atctggttaggctggtgtta

SEQ ID NO: 2657 - DNA, 20 bp, Artificial Sequence
  gRNA target sequence
aatctggttaggctggtgtt

SEQ ID NO: 2658 - DNA, 20 bp, Artificial Sequence
  gRNA target sequence
aatttgaaatctggttaggc

SEQ ID NO: 2659 - DNA, 20 bp, Artificial Sequence
  gRNA target sequence
ataaaatttgaaatctggtt

SEQ ID NO: 2660 - DNA, 20 bp, Artificial Sequence
  gRNA target sequence
aaaagataaaatttgaaatc

SEQ ID NO: 2661 - DNA, 20 bp, Artificial Sequence
  gRNA target sequence
aaaataatgtgttagttggg

SEQ ID NO: 2662 - DNA, 20 bp, Artificial Sequence
  gRNA target sequence
gaaaataatgtgttagttgg

SEQ ID NO: 2663 - DNA, 20 bp, Artificial Sequence
  gRNA target sequence
ggaaaataatgtgttagttg

SEQ ID NO: 2664 - DNA, 20 bp, Artificial Sequence
  gRNA target sequence
gggaaaataatgtgttagtt

SEQ ID NO: 2665 - DNA, 20 bp, Artificial Sequence
  gRNA target sequence
ggggaaaataatgtgttagt

SEQ ID NO: 2666 - DNA, 20 bp, Artificial Sequence
  gRNA target sequence
tagtagtatgggagtgggag

SEQ ID NO: 2667 - DNA, 20 bp, Artificial Sequence
  gRNA target sequence
ttagtagtatgggagtggga

SEQ ID NO: 2668 - DNA, 20 bp, Artificial Sequence
  gRNA target sequence
attagtagtatgggagtggg

SEQ ID NO: 2669 - DNA, 20 bp, Artificial Sequence
  gRNA target sequence
gagattagtagtatgggagt

SEQ ID NO: 2670 - DNA, 20 bp, Artificial Sequence
  gRNA target sequence
tgagattagtagtatgggag

SEQ ID NO: 2671 - DNA, 20 bp, Artificial Sequence
  gRNA target sequence
attgatgagattagtagtat

SEQ ID NO: 2672 - DNA, 20 bp, Artificial Sequence
  gRNA target sequence
tattgatgagattagtagta

SEQ ID NO: 2673 - DNA, 20 bp, Artificial Sequence
  gRNA target sequence
gtgctgggtaggatgggcgg

SEQ ID NO: 2674 - DNA, 20 bp, Artificial Sequence
  gRNA target sequence
tgtgctgggtaggatgggcg

SEQ ID NO: 2675 - DNA, 20 bp, Artificial Sequence
  gRNA target sequence
gtgtgctgggtaggatgggc

SEQ ID NO: 2676 - DNA, 20 bp, Artificial Sequence
  gRNA target sequence
tgtgtgctgggtaggatggg

SEQ ID NO: 2677 - DNA, 20 bp, Artificial Sequence
  gRNA target sequence
gtgtgtgtgctgggtaggat

SEQ ID NO: 2678 - DNA, 20 bp, Artificial Sequence
  gRNA target sequence
tgtgtgtgtgctgggtagga

SEQ ID NO: 2679 - DNA, 20 bp, Artificial Sequence
  gRNA target sequence
gcggtgtgtgtgtgctgggt

SEQ ID NO: 2680 - DNA, 20 bp, Artificial Sequence
  gRNA target sequence
agcagcggtgtgtgtgtgct

SEQ ID NO: 2681 - DNA, 20 bp, Artificial Sequence
  gRNA target sequence
tagcagcggtgtgtgtgtgc

SEQ ID NO: 2682 - DNA, 20 bp, Artificial Sequence
  gRNA target sequence
tcggggtatggggttagcag

SEQ ID NO: 2683 - DNA, 20 bp, Artificial Sequence
  gRNA target sequence
tttggttggttcggggtatg

SEQ ID NO: 2684 - DNA, 20 bp, Artificial Sequence
  gRNA target sequence
gtttggttggttcggggtat

SEQ ID NO: 2685 - DNA, 20 bp, Artificial Sequence
  gRNA target sequence
ggtttggttggttcggggta

SEQ ID NO: 2686 - DNA, 20 bp, Artificial Sequence
  gRNA target sequence
tttggggtttggttggttcg

SEQ ID NO: 2687 - DNA, 20 bp, Artificial Sequence
  gRNA target sequence
ctttggggtttggttggttc

SEQ ID NO: 2688 - DNA, 20 bp, Artificial Sequence
  gRNA target sequence
tctttggggtttggttggtt

SEQ ID NO: 2689 - DNA, 20 bp, Artificial Sequence
  gRNA target sequence
gggtgtctttggggtttggt

SEQ ID NO: 2690 - DNA, 20 bp, Artificial Sequence
  gRNA target sequence
tggggggtgtctttggggtt

SEQ ID NO: 2691 - DNA, 20 bp, Artificial Sequence
  gRNA target sequence
aactgtggggggtgtctttg

SEQ ID NO: 2692 - DNA, 20 bp, Artificial Sequence
  gRNA target sequence
aaactgtggggggtgtcttt

SEQ ID NO: 2693 - DNA, 20 bp, Artificial Sequence
  gRNA target sequence
taaactgtggggggtgtctt

SEQ ID NO: 2694 - DNA, 20 bp, Artificial Sequence
  gRNA target sequence
taagctacataaactgtggg

SEQ ID NO: 2695 - DNA, 20 bp, Artificial Sequence
  gRNA target sequence
gtaagctacataaactgtgg

SEQ ID NO: 2696 - DNA, 20 bp, Artificial Sequence
  gRNA target sequence
ggtaagctacataaactgtg

SEQ ID NO: 2697 - DNA, 20 bp, Artificial Sequence
  gRNA target sequence
aggtaagctacataaactgt

SEQ ID NO: 2698 - DNA, 20 bp, Artificial Sequence
  gRNA target sequence
gaggtaagctacataaactg

SEQ ID NO: 2699 - DNA, 20 bp, Artificial Sequence
  gRNA target sequence
ttcagtgtattgctttgagg

SEQ ID NO: 2700 - DNA, 20 bp, Artificial Sequence
  gRNA target sequence
attttcagtgtattgctttg

SEQ ID NO: 2701 - DNA, 20 bp, Artificial Sequence
  gRNA target sequence
accaaacctatttgtttatg

SEQ ID NO: 2702 - DNA, 20 bp, Artificial Sequence
  gRNA target sequence
gaccaaacctatttgtttat

SEQ ID NO: 2703 - DNA, 20 bp, Artificial Sequence
  gRNA target sequence
ggaccaaacctatttgttta

SEQ ID NO: 2704 - DNA, 20 bp, Artificial Sequence
  gRNA target sequence
taagagctaatagaaaggct

SEQ ID NO: 2705 - DNA, 20 bp, Artificial Sequence
  gRNA target sequence
cttactaagagctaatagaa

SEQ ID NO: 2706 - DNA, 20 bp, Artificial Sequence
  gRNA target sequence
agggtgaactcactggaacg

SEQ ID NO: 2707 - DNA, 20 bp, Artificial Sequence
  gRNA target sequence
gagggtgaactcactggaac

SEQ ID NO: 2708 - DNA, 20 bp, Artificial Sequence
  gRNA target sequence
agagggtgaactcactggaa

SEQ ID NO: 2709 - DNA, 20 bp, Artificial Sequence
  gRNA target sequence
gatttagagggtgaactcac

SEQ ID NO: 2710 - DNA, 20 bp, Artificial Sequence
  gRNA target sequence
tttgatcgtggtgatttaga

SEQ ID NO: 2711 - DNA, 20 bp, Artificial Sequence
  gRNA target sequence
ttttgatcgtggtgatttag

SEQ ID NO: 2712 - DNA, 20 bp, Artificial Sequence
  gRNA target sequence
atgcttgttccttttgatcg

SEQ ID NO: 2713 - DNA, 20 bp, Artificial Sequence
  gRNA target sequence
tttcccgtgggggtgtggct

SEQ ID NO: 2714 - DNA, 20 bp, Artificial Sequence
  gRNA target sequence
tgctgtttcccgtgggggtg

SEQ ID NO: 2715 - DNA, 20 bp, Artificial Sequence
  gRNA target sequence
atcactgctgtttcccgtgg

SEQ ID NO: 2716 - DNA, 20 bp, Artificial Sequence
  gRNA target sequence
aatcactgctgtttcccgtg

SEQ ID NO: 2717 - DNA, 20 bp, Artificial Sequence
  gRNA target sequence
taatcactgctgtttcccgt

SEQ ID NO: 2718 - DNA, 20 bp, Artificial Sequence
  gRNA target sequence
ttaatcactgctgtttcccg

SEQ ID NO: 2719 - DNA, 20 bp, Artificial Sequence
  gRNA target sequence
aaactttcgtttattgctaa

SEQ ID NO: 2720 - DNA, 20 bp, Artificial Sequence
  gRNA target sequence
cacgaaattgaccaaccctg

SEQ ID NO: 2721 - DNA, 20 bp, Artificial Sequence
  gRNA target sequence
gcacgaaattgaccaaccct

SEQ ID NO: 2722 - DNA, 20 bp, Artificial Sequence
  gRNA target sequence
ggcacgaaattgaccaaccc

SEQ ID NO: 2723 - DNA, 20 bp, Artificial Sequence
  gRNA target sequence
aatcgtgtgaccgcggtggc

SEQ ID NO: 2724 - DNA, 20 bp, Artificial Sequence
  gRNA target sequence
ggttaatcgtgtgaccgcgg

SEQ ID NO: 2725 - DNA, 20 bp, Artificial Sequence
  gRNA target sequence
ttgggttaatcgtgtgaccg

SEQ ID NO: 2726 - DNA, 20 bp, Artificial Sequence
  gRNA target sequence
acgccggcttctattgactt

SEQ ID NO: 2727 - DNA, 20 bp, Artificial Sequence
  gRNA target sequence
tacgccggcttctattgact

SEQ ID NO: 2728 - DNA, 20 bp, Artificial Sequence
  gRNA target sequence
atctaaaacactctttacgc

SEQ ID NO: 2729 - DNA, 20 bp, Artificial Sequence
  gRNA target sequence
ttttagctttattggggagg

SEQ ID NO: 2730 - DNA, 20 bp, Artificial Sequence
  gRNA target sequence
gttttagctttattggggag

SEQ ID NO: 2731 - DNA, 20 bp, Artificial Sequence
  gRNA target sequence
agttttagctttattgggga

SEQ ID NO: 2732 - DNA, 20 bp, Artificial Sequence
  gRNA target sequence
gagttttagctttattgggg

SEQ ID NO: 2733 - DNA, 20 bp, Artificial Sequence
  gRNA target sequence
ggtgagttttagctttattg

SEQ ID NO: 2734 - DNA, 20 bp, Artificial Sequence
  gRNA target sequence
aggtgagttttagctttatt

SEQ ID NO: 2735 - DNA, 20 bp, Artificial Sequence
  gRNA target sequence
caggtgagttttagctttat

SEQ ID NO: 2736 - DNA, 20 bp, Artificial Sequence
  gRNA target sequence
actggagttttttacaactc

SEQ ID NO: 2737 - DNA, 20 bp, Artificial Sequence
  gRNA target sequence
gtagtctattttgtgtcaac

SEQ ID NO: 2738 - DNA, 20 bp, Artificial Sequence
  gRNA target sequence
ggggtatctaatcccagttt

SEQ ID NO: 2739 - DNA, 20 bp, Artificial Sequence
  gRNA target sequence
tggggtatctaatcccagtt

SEQ ID NO: 2740 - DNA, 20 bp, Artificial Sequence
  gRNA target sequence
gtttagggctaagcatagtg

SEQ ID NO: 2741 - DNA, 20 bp, Artificial Sequence
  gRNA target sequence
ggtttagggctaagcatagt

SEQ ID NO: 2742 - DNA, 20 bp, Artificial Sequence
  gRNA target sequence
aggtttagggctaagcatag

SEQ ID NO: 2743 - DNA, 20 bp, Artificial Sequence
  gRNA target sequence
gatttaactgttgaggttta

SEQ ID NO: 2744 - DNA, 20 bp, Artificial Sequence
  gRNA target sequence
tgatttaactgttgaggttt

SEQ ID NO: 2745 - DNA, 20 bp, Artificial Sequence
  gRNA target sequence
ttttgttgatttaactgttg

SEQ ID NO: 2746 - DNA, 20 bp, Artificial Sequence
  gRNA target sequence
agctgtggctcgtagtgttc

SEQ ID NO: 2747 - DNA, 20 bp, Artificial Sequence
  gRNA target sequence
gtcctttgagttttaagctg

SEQ ID NO: 2748 - DNA, 20 bp, Artificial Sequence
  gRNA target sequence
gagggatatgaagcaccgcc

SEQ ID NO: 2749 - DNA, 20 bp, Artificial Sequence
  gRNA target sequence
acagaacaggctcctctaga

SEQ ID NO: 2750 - DNA, 20 bp, Artificial Sequence
  gRNA target sequence
tacagaacaggctcctctag

SEQ ID NO: 2751 - DNA, 20 bp, Artificial Sequence
  gRNA target sequence
gggtttatcgattacagaac

SEQ ID NO: 2752 - DNA, 20 bp, Artificial Sequence
  gRNA target sequence
agaggtggtgaggttgatcg

SEQ ID NO: 2753 - DNA, 20 bp, Artificial Sequence
  gRNA target sequence
aagaggtggtgaggttgatc

SEQ ID NO: 2754 - DNA, 20 bp, Artificial Sequence
  gRNA target sequence
caagaggtggtgaggttgat

SEQ ID NO: 2755 - DNA, 20 bp, Artificial Sequence
  gRNA target sequence
aggctgagcaagaggtggtg

SEQ ID NO: 2756 - DNA, 20 bp, Artificial Sequence
  gRNA target sequence
tatataggctgagcaagagg

SEQ ID NO: 2757 - DNA, 20 bp, Artificial Sequence
  gRNA target sequence
cggtatataggctgagcaag

SEQ ID NO: 2758 - DNA, 20 bp, Artificial Sequence
  gRNA target sequence
tgctgaagatggcggtatat

SEQ ID NO: 2759 - DNA, 20 bp, Artificial Sequence
  gRNA target sequence
tcagggtttgctgaagatgg

SEQ ID NO: 2760 - DNA, 20 bp, Artificial Sequence
  gRNA target sequence
tcatcagggtttgctgaaga

SEQ ID NO: 2761 - DNA, 20 bp, Artificial Sequence
  gRNA target sequence
ttactttgtagccttcatca

SEQ ID NO: 2762 - DNA, 20 bp, Artificial Sequence
  gRNA target sequence
cttactttgtagccttcatc

SEQ ID NO: 2763 - DNA, 20 bp, Artificial Sequence
  gRNA target sequence
ttgacctaacgtctttacgt

SEQ ID NO: 2764 - DNA, 20 bp, Artificial Sequence
  gRNA target sequence
cttgacctaacgtctttacg

SEQ ID NO: 2765 - DNA, 20 bp, Artificial Sequence
  gRNA target sequence
cccatttcttgccacctcat

SEQ ID NO: 2766 - DNA, 20 bp, Artificial Sequence
  gRNA target sequence
gcccatttcttgccacctca

SEQ ID NO: 2767 - DNA, 20 bp, Artificial Sequence
  gRNA target sequence
agggctatcgtagttttctg

SEQ ID NO: 2768 - DNA, 20 bp, Artificial Sequence
  gRNA target sequence
aagggctatcgtagttttct

SEQ ID NO: 2769 - DNA, 20 bp, Artificial Sequence
  gRNA target sequence
taagggctatcgtagttttc

SEQ ID NO: 2770 - DNA, 20 bp, Artificial Sequence
  gRNA target sequence
tcgacccttaagtttcataa

SEQ ID NO: 2771 - DNA, 20 bp, Artificial Sequence
  gRNA target sequence
ttcgacccttaagtttcata

SEQ ID NO: 2772 - DNA, 20 bp, Artificial Sequence
  gRNA target sequence
ggcggtgtgtacgcgcttca

SEQ ID NO: 2773 - DNA, 20 bp, Artificial Sequence
  gRNA target sequence
gggcggtgtgtacgcgcttc

SEQ ID NO: 2774 - DNA, 20 bp, Artificial Sequence
  gRNA target sequence
tacttgaggagggtgacggg

SEQ ID NO: 2775 - DNA, 20 bp, Artificial Sequence
  gRNA target sequence
gtatacttgaggagggtgac

SEQ ID NO: 2776 - DNA, 20 bp, Artificial Sequence
  gRNA target sequence
agtatacttgaggagggtga

SEQ ID NO: 2777 - DNA, 20 bp, Artificial Sequence
  gRNA target sequence
ctttgaagtatacttgagga

SEQ ID NO: 2778 - DNA, 20 bp, Artificial Sequence
  gRNA target sequence
cctttgaagtatacttgagg

SEQ ID NO: 2779 - DNA, 20 bp, Artificial Sequence
  gRNA target sequence
tgtcctttgaagtatacttg

SEQ ID NO: 2780 - DNA, 20 bp, Artificial Sequence
  gRNA target sequence
tcctctatataaatgcgtag

SEQ ID NO: 2781 - DNA, 20 bp, Artificial Sequence
  gRNA target sequence
ctcctctatataaatgcgta

SEQ ID NO: 2782 - DNA, 20 bp, Artificial Sequence
  gRNA target sequence
tctcctctatataaatgcgt

SEQ ID NO: 2783 - DNA, 20 bp, Artificial Sequence
  gRNA target sequence
ctttgtgttaagctacactc

SEQ ID NO: 2784 - DNA, 20 bp, Artificial Sequence
  gRNA target sequence
aaatctcctaagtgtaagtt

SEQ ID NO: 2785 - DNA, 20 bp, Artificial Sequence
  gRNA target sequence
gaaatctcctaagtgtaagt

SEQ ID NO: 2786 - DNA, 20 bp, Artificial Sequence
  gRNA target sequence
gggctaggtttagctcagag

SEQ ID NO: 2787 - DNA, 20 bp, Artificial Sequence
  gRNA target sequence
ggtggagtgggtttggggct

SEQ ID NO: 2788 - DNA, 20 bp, Artificial Sequence
  gRNA target sequence
agtaaggtggagtgggtttg

SEQ ID NO: 2789 - DNA, 20 bp, Artificial Sequence
  gRNA target sequence
tagtaaggtggagtgggttt

SEQ ID NO: 2790 - DNA, 20 bp, Artificial Sequence
  gRNA target sequence
gtagtaaggtggagtgggtt

SEQ ID NO: 2791 - DNA, 20 bp, Artificial Sequence
  gRNA target sequence
gtctggtagtaaggtggagt

SEQ ID NO: 2792 - DNA, 20 bp, Artificial Sequence
  gRNA target sequence
tgtctggtagtaaggtggag

SEQ ID NO: 2793 - DNA, 20 bp, Artificial Sequence
  gRNA target sequence
aaggttgtctggtagtaagg

SEQ ID NO: 2794 - DNA, 20 bp, Artificial Sequence
  gRNA target sequence
gctaaggttgtctggtagta

SEQ ID NO: 2795 - DNA, 20 bp, Artificial Sequence
  gRNA target sequence
atggtttggctaaggttgtc

SEQ ID NO: 2796 - DNA, 20 bp, Artificial Sequence
  gRNA target sequence
ttgggtaaatggtttggcta

SEQ ID NO: 2797 - DNA, 20 bp, Artificial Sequence
  gRNA target sequence
ctttatttgggtaaatggtt

SEQ ID NO: 2798 - DNA, 20 bp, Artificial Sequence
  gRNA target sequence
ctatactttatttgggtaaa

SEQ ID NO: 2799 - DNA, 20 bp, Artificial Sequence
  gRNA target sequence
ctatcgcctatactttattt

SEQ ID NO: 2800 - DNA, 20 bp, Artificial Sequence
  gRNA target sequence
tctatcgcctatactttatt

SEQ ID NO: 2801 - DNA, 20 bp, Artificial Sequence
  gRNA target sequence
ggtactatatctattgcgcc

SEQ ID NO: 2802 - DNA, 20 bp, Artificial Sequence
  gRNA target sequence
aatttttcatctttcccttg

SEQ ID NO: 2803 - DNA, 20 bp, Artificial Sequence
  gRNA target sequence
agtccttgctatattatgct

SEQ ID NO: 2804 - DNA, 20 bp, Artificial Sequence
  gRNA target sequence
tcattatgcagaaggtatag

SEQ ID NO: 2805 - DNA, 20 bp, Artificial Sequence
  gRNA target sequence
ttcattatgcagaaggtata

SEQ ID NO: 2806 - DNA, 20 bp, Artificial Sequence
  gRNA target sequence
attcattatgcagaaggtat

SEQ ID NO: 2807 - DNA, 20 bp, Artificial Sequence
  gRNA target sequence
tagttaattcattatgcaga

SEQ ID NO: 2808 - DNA, 20 bp, Artificial Sequence
  gRNA target sequence
ggtttcgggggtcttagctt

SEQ ID NO: 2809 - DNA, 20 bp, Artificial Sequence
  gRNA target sequence
ggtagctcgtctggtttcgg

SEQ ID NO: 2810 - DNA, 20 bp, Artificial Sequence
  gRNA target sequence
aggtagctcgtctggtttcg

SEQ ID NO: 2811 - DNA, 20 bp, Artificial Sequence
  gRNA target sequence
taggtagctcgtctggtttc

SEQ ID NO: 2812 - DNA, 20 bp, Artificial Sequence
  gRNA target sequence
ttaggtagctcgtctggttt

SEQ ID NO: 2813 - DNA, 20 bp, Artificial Sequence
  gRNA target sequence
ctgttcttaggtagctcgtc

SEQ ID NO: 2814 - DNA, 20 bp, Artificial Sequence
  gRNA target sequence
gtgctcttttagctgttctt

SEQ ID NO: 2815 - DNA, 20 bp, Artificial Sequence
  gRNA target sequence
cactattttgctacatagac

SEQ ID NO: 2816 - DNA, 20 bp, Artificial Sequence
  gRNA target sequence
ccactattttgctacataga

SEQ ID NO: 2817 - DNA, 20 bp, Artificial Sequence
  gRNA target sequence
cagctatcaccaggctcggt

SEQ ID NO: 2818 - DNA, 20 bp, Artificial Sequence
  gRNA target sequence
caaccagctatcaccaggct

SEQ ID NO: 2819 - DNA, 20 bp, Artificial Sequence
  gRNA target sequence
ttggacaaccagctatcacc

SEQ ID NO: 2820 - DNA, 20 bp, Artificial Sequence
  gRNA target sequence
gttgaactaagattctatct

SEQ ID NO: 2821 - DNA, 20 bp, Artificial Sequence
  gRNA target sequence
ggggatttagagggttctgt

SEQ ID NO: 2822 - DNA, 20 bp, Artificial Sequence
  gRNA target sequence
aggggatttagagggttctg

SEQ ID NO: 2823 - DNA, 20 bp, Artificial Sequence
  gRNA target sequence
aatttacaaggggatttaga

SEQ ID NO: 2824 - DNA, 20 bp, Artificial Sequence
  gRNA target sequence
aaatttacaaggggatttag

SEQ ID NO: 2825 - DNA, 20 bp, Artificial Sequence
  gRNA target sequence
ctaacagttaaatttacaag

SEQ ID NO: 2826 - DNA, 20 bp, Artificial Sequence
  gRNA target sequence
actaacagttaaatttacaa

SEQ ID NO: 2827 - DNA, 20 bp, Artificial Sequence
  gRNA target sequence
gactaacagttaaatttaca

SEQ ID NO: 2828 - DNA, 20 bp, Artificial Sequence
  gRNA target sequence
tccaaagagctgttcctctt

SEQ ID NO: 2829 - DNA, 20 bp, Artificial Sequence
  gRNA target sequence
aattttttactctctctaca

SEQ ID NO: 2830 - DNA, 20 bp, Artificial Sequence
  gRNA target sequence
gctgcttttaggcctactat

SEQ ID NO: 2831 - DNA, 20 bp, Artificial Sequence
  gRNA target sequence
ggctgcttttaggcctacta

SEQ ID NO: 2832 - DNA, 20 bp, Artificial Sequence
  gRNA target sequence
cttaattggtggctgctttt

SEQ ID NO: 2833 - DNA, 20 bp, Artificial Sequence
  gRNA target sequence
ttgaacgctttcttaattgg

SEQ ID NO: 2834 - DNA, 20 bp, Artificial Sequence
  gRNA target sequence
agcttgaacgctttcttaat

SEQ ID NO: 2835 - DNA, 20 bp, Artificial Sequence
  gRNA target sequence
tttgggattttttaggtagt

SEQ ID NO: 2836 - DNA, 20 bp, Artificial Sequence
  gRNA target sequence
gtttgggattttttaggtag

SEQ ID NO: 2837 - DNA, 20 bp, Artificial Sequence
  gRNA target sequence
ttatatgtttgggatttttt

SEQ ID NO: 2838 - DNA, 20 bp, Artificial Sequence
  gRNA target sequence
aggagttcagttatatgttt

SEQ ID NO: 2839 - DNA, 20 bp, Artificial Sequence
  gRNA target sequence
gaggagttcagttatatgtt

SEQ ID NO: 2840 - DNA, 20 bp, Artificial Sequence
  gRNA target sequence
gattggtccaattgggtgtg

SEQ ID NO: 2841 - DNA, 20 bp, Artificial Sequence
  gRNA target sequence
ggtgatagattggtccaatt

SEQ ID NO: 2842 - DNA, 20 bp, Artificial Sequence
  gRNA target sequence
gggtgatagattggtccaat

SEQ ID NO: 2843 - DNA, 20 bp, Artificial Sequence
  gRNA target sequence
tcttctatagggtgatagat

SEQ ID NO: 2844 - DNA, 20 bp, Artificial Sequence
  gRNA target sequence
ctaacattagttcttctata

SEQ ID NO: 2845 - DNA, 20 bp, Artificial Sequence
  gRNA target sequence
actaacattagttcttctat

SEQ ID NO: 2846 - DNA, 20 bp, Artificial Sequence
  gRNA target sequence
tctgacgcaggcttatgcgg

SEQ ID NO: 2847 - DNA, 20 bp, Artificial Sequence
  gRNA target sequence
taatctgacgcaggcttatg

SEQ ID NO: 2848 - DNA, 20 bp, Artificial Sequence
  gRNA target sequence
tcagtgttttaatctgacgc

SEQ ID NO: 2849 - DNA, 20 bp, Artificial Sequence
  gRNA target sequence
gttggttgattgtagatatt

SEQ ID NO: 2850 - DNA, 20 bp, Artificial Sequence
  gRNA target sequence
tgttggttgattgtagatat

SEQ ID NO: 2851 - DNA, 20 bp, Artificial Sequence
  gRNA target sequence
tgagggtaataatgacttgt

SEQ ID NO: 2852 - DNA, 20 bp, Artificial Sequence
  gRNA target sequence
ctgtgttgggttgacagtga

SEQ ID NO: 2853 - DNA, 20 bp, Artificial Sequence
  gRNA target sequence
cctgtgttgggttgacagtg

SEQ ID NO: 2854 - DNA, 20 bp, Artificial Sequence
  gRNA target sequence
cttatgagcatgcctgtgtt

SEQ ID NO: 2855 - DNA, 20 bp, Artificial Sequence
  gRNA target sequence
ccttatgagcatgcctgtgt

SEQ ID NO: 2856 - DNA, 20 bp, Artificial Sequence
  gRNA target sequence
atgtttttggtaaacaggcg

SEQ ID NO: 2857 - DNA, 20 bp, Artificial Sequence
  gRNA target sequence
gatgtttttggtaaacaggc

SEQ ID NO: 2858 - DNA, 20 bp, Artificial Sequence
  gRNA target sequence
tgatgtttttggtaaacagg

SEQ ID NO: 2859 - DNA, 20 bp, Artificial Sequence
  gRNA target sequence
aggtgatgtttttggtaaac

SEQ ID NO: 2860 - DNA, 20 bp, Artificial Sequence
  gRNA target sequence
gatgctagaggtgatgtttt

SEQ ID NO: 2861 - DNA, 20 bp, Artificial Sequence
  gRNA target sequence
tctaatactggtgatgctag

SEQ ID NO: 2862 - DNA, 20 bp, Artificial Sequence
  gRNA target sequence
gcaggcggtgcctctaatac

SEQ ID NO: 2863 - DNA, 20 bp, Artificial Sequence
  gRNA target sequence
aacatgtgtcactgggcagg

SEQ ID NO: 2864 - DNA, 20 bp, Artificial Sequence
  gRNA target sequence
ttaaacatgtgtcactgggc

SEQ ID NO: 2865 - DNA, 20 bp, Artificial Sequence
  gRNA target sequence
gccgttaaacatgtgtcact

SEQ ID NO: 2866 - DNA, 20 bp, Artificial Sequence
  gRNA target sequence
ggccgttaaacatgtgtcac

SEQ ID NO: 2867 - DNA, 20 bp, Artificial Sequence
  gRNA target sequence
tttgcacggttagggtaccg

SEQ ID NO: 2868 - DNA, 20 bp, Artificial Sequence
  gRNA target sequence
atgctacctttgcacggtta

SEQ ID NO: 2869 - DNA, 20 bp, Artificial Sequence
  gRNA target sequence
tatgctacctttgcacggtt

SEQ ID NO: 2870 - DNA, 20 bp, Artificial Sequence
  gRNA target sequence
gtgattatgctacctttgca

SEQ ID NO: 2871 - DNA, 20 bp, Artificial Sequence
  gRNA target sequence
ttcatacaggtccctattta

SEQ ID NO: 2872 - DNA, 20 bp, Artificial Sequence
  gRNA target sequence
cctcgtggagccattcatac

SEQ ID NO: 2873 - DNA, 20 bp, Artificial Sequence
  gRNA target sequence
aagagacagctgaaccctcg

SEQ ID NO: 2874 - DNA, 20 bp, Artificial Sequence
  gRNA target sequence
cacgggcaggtcaatttcac

SEQ ID NO: 2875 - DNA, 20 bp, Artificial Sequence
  gRNA target sequence
atgcccgcctcttcacgggc

SEQ ID NO: 2876 - DNA, 20 bp, Artificial Sequence
  gRNA target sequence
tgttatgcccgcctcttcac

SEQ ID NO: 2877 - DNA, 20 bp, Artificial Sequence
  gRNA target sequence
gtgttatgcccgcctcttca

SEQ ID NO: 2878 - DNA, 20 bp, Artificial Sequence
  gRNA target sequence
taataaattaaagctccata

SEQ ID NO: 2879 - DNA, 20 bp, Artificial Sequence
  gRNA target sequence
ttaataaattaaagctccat

SEQ ID NO: 2880 - DNA, 20 bp, Artificial Sequence
  gRNA target sequence
ttaggacctgtgggtttgtt

SEQ ID NO: 2881 - DNA, 20 bp, Artificial Sequence
  gRNA target sequence
tttggtagtttaggacctgt

SEQ ID NO: 2882 - DNA, 20 bp, Artificial Sequence
  gRNA target sequence
gtttggtagtttaggacctg

SEQ ID NO: 2883 - DNA, 20 bp, Artificial Sequence
  gRNA target sequence
taatgcaggtttggtagttt

SEQ ID NO: 2884 - DNA, 20 bp, Artificial Sequence
  gRNA target sequence
cgaaatttttaatgcaggtt

SEQ ID NO: 2885 - DNA, 20 bp, Artificial Sequence
  gRNA target sequence
ccaaccgaaatttttaatgc

SEQ ID NO: 2886 - DNA, 20 bp, Artificial Sequence
  gRNA target sequence
ggaggttgggttctgctccg

SEQ ID NO: 2887 - DNA, 20 bp, Artificial Sequence
  gRNA target sequence
gcatgtactgctcggaggtt

SEQ ID NO: 2888 - DNA, 20 bp, Artificial Sequence
  gRNA target sequence
agcatgtactgctcggaggt

SEQ ID NO: 2889 - DNA, 20 bp, Artificial Sequence
  gRNA target sequence
tcttagcatgtactgctcgg

SEQ ID NO: 2890 - DNA, 20 bp, Artificial Sequence
  gRNA target sequence
aagtcttagcatgtactgct

SEQ ID NO: 2891 - DNA, 20 bp, Artificial Sequence
  gRNA target sequence
gtatagtagttcgctttgac

SEQ ID NO: 2892 - DNA, 20 bp, Artificial Sequence
  gRNA target sequence
tgttccgttggtcaagttat

SEQ ID NO: 2893 - DNA, 20 bp, Artificial Sequence
  gRNA target sequence
cctagggtaacttgttccgt

SEQ ID NO: 2894 - DNA, 20 bp, Artificial Sequence
  gRNA target sequence
ggattgcgctgttatcccta

SEQ ID NO: 2895 - DNA, 20 bp, Artificial Sequence
  gRNA target sequence
aggattgcgctgttatccct

SEQ ID NO: 2896 - DNA, 20 bp, Artificial Sequence
  gRNA target sequence
gttgatatggactctagaat

SEQ ID NO: 2897 - DNA, 20 bp, Artificial Sequence
  gRNA target sequence
cgtaaaccctattgttgata

SEQ ID NO: 2898 - DNA, 20 bp, Artificial Sequence
  gRNA target sequence
gatgtcctgatccaacatcg

SEQ ID NO: 2899 - DNA, 20 bp, Artificial Sequence
  gRNA target sequence
ttaatagcggctgcaccatc

SEQ ID NO: 2900 - DNA, 20 bp, Artificial Sequence
  gRNA target sequence
tttaatagcggctgcaccat

SEQ ID NO: 2901 - DNA, 20 bp, Artificial Sequence
  gRNA target sequence
aacaaacgaacctttaatag

SEQ ID NO: 2902 - DNA, 20 bp, Artificial Sequence
  gRNA target sequence
ggtctgaactcagatcacgt

SEQ ID NO: 2903 - DNA, 20 bp, Artificial Sequence
  gRNA target sequence
gaaaccgacctggattactc

SEQ ID NO: 2904 - DNA, 20 bp, Artificial Sequence
  gRNA target sequence
  variation (3)...(3): n = A, T, C, or G
aangtagatagaaaccgacc

SEQ ID NO: 2905 - DNA, 20 bp, Artificial Sequence
  gRNA target sequence
tcttgtcctttcgtacaggg

SEQ ID NO: 2906 - DNA, 20 bp, Artificial Sequence
  gRNA target sequence
ttctcttgtcctttcgtaca

SEQ ID NO: 2907 - DNA, 20 bp, Artificial Sequence
  gRNA target sequence
tttctcttgtcctttcgtac

SEQ ID NO: 2908 - DNA, 20 bp, Artificial Sequence
  gRNA target sequence
gggaaggcgctttgtgaagt

SEQ ID NO: 2909 - DNA, 20 bp, Artificial Sequence
  gRNA target sequence
atgatatcatttacggggga

SEQ ID NO: 2910 - DNA, 20 bp, Artificial Sequence
  gRNA target sequence
tgagatgatatcatttacgg

SEQ ID NO: 2911 - DNA, 20 bp, Artificial Sequence
  gRNA target sequence
ttgagatgatatcatttacg

SEQ ID NO: 2912 - DNA, 20 bp, Artificial Sequence
  gRNA target sequence
gttgagatgatatcatttac

SEQ ID NO: 2913 - DNA, 20 bp, Artificial Sequence
  gRNA target sequence
agttgagatgatatcattta

SEQ ID NO: 2914 - DNA, 20 bp, Artificial Sequence
  gRNA target sequence
ccctgttcttgggtgggtgt

SEQ ID NO: 2915 - DNA, 20 bp, Artificial Sequence
  gRNA target sequence
accctgttcttgggtgggtg

SEQ ID NO: 2916 - DNA, 20 bp, Artificial Sequence
  gRNA target sequence
aacaaaccctgttcttgggt

SEQ ID NO: 2917 - DNA, 20 bp, Artificial Sequence
  gRNA target sequence
taacaaaccctgttcttggg

SEQ ID NO: 2918 - DNA, 20 bp, Artificial Sequence
  gRNA target sequence
tcttaacaaaccctgttctt

SEQ ID NO: 2919 - DNA, 20 bp, Artificial Sequence
  gRNA target sequence
atcttaacaaaccctgttct

SEQ ID NO: 2920 - DNA, 20 bp, Artificial Sequence
  gRNA target sequence
ttaagttttatgcgattacc

SEQ ID NO: 2921 - DNA, 20 bp, Artificial Sequence
  gRNA target sequence
tttaagttttatgcgattac

SEQ ID NO: 2922 - DNA, 20 bp, Artificial Sequence
  gRNA target sequence
atgggtatgttgttaagaag

SEQ ID NO: 2923 - DNA, 20 bp, Artificial Sequence
  gRNA target sequence
aggagtaggaggttggccat

SEQ ID NO: 2924 - DNA, 20 bp, Artificial Sequence
  gRNA target sequence
gaggagtaggaggttggcca

SEQ ID NO: 2925 - DNA, 20 bp, Artificial Sequence
  gRNA target sequence
tacaatgaggagtaggaggt

SEQ ID NO: 2926 - DNA, 20 bp, Artificial Sequence
  gRNA target sequence
tgggtacaatgaggagtagg

SEQ ID NO: 2927 - DNA, 20 bp, Artificial Sequence
  gRNA target sequence
gaatgggtacaatgaggagt

SEQ ID NO: 2928 - DNA, 20 bp, Artificial Sequence
  gRNA target sequence
cgattagaatgggtacaatg

SEQ ID NO: 2929 - DNA, 20 bp, Artificial Sequence
  gRNA target sequence
aatgccattgcgattagaat

SEQ ID NO: 2930 - DNA, 20 bp, Artificial Sequence
  gRNA target sequence
gaatgccattgcgattagaa

SEQ ID NO: 2931 - DNA, 20 bp, Artificial Sequence
  gRNA target sequence
tttttcgttcggtaagcatt

SEQ ID NO: 2932 - DNA, 20 bp, Artificial Sequence
  gRNA target sequence
atagcctagaatttttcgtt

SEQ ID NO: 2933 - DNA, 20 bp, Artificial Sequence
  gRNA target sequence
cgtaggggcctacaacgttg

SEQ ID NO: 2934 - DNA, 20 bp, Artificial Sequence
  gRNA target sequence
ccgtaggggcctacaacgtt

SEQ ID NO: 2935 - DNA, 20 bp, Artificial Sequence
  gRNA target sequence
cccgtaggggcctacaacgt

SEQ ID NO: 2936 - DNA, 20 bp, Artificial Sequence
  gRNA target sequence
agggttgtagtagcccgtag

SEQ ID NO: 2937 - DNA, 20 bp, Artificial Sequence
  gRNA target sequence
aagggttgtagtagcccgta

SEQ ID NO: 2938 - DNA, 20 bp, Artificial Sequence
  gRNA target sequence
gaagggttgtagtagcccgt

SEQ ID NO: 2939 - DNA, 20 bp, Artificial Sequence
  gRNA target sequence
agttttatggcgtcagcgaa

SEQ ID NO: 2940 - DNA, 20 bp, Artificial Sequence
  gRNA target sequence
gagttttatggcgtcagcga

SEQ ID NO: 2941 - DNA, 20 bp, Artificial Sequence
  gRNA target sequence
ctctttggtgaagagtttta

SEQ ID NO: 2942 - DNA, 20 bp, Artificial Sequence
  gRNA target sequence
ggcgggttttaggggctctt

SEQ ID NO: 2943 - DNA, 20 bp, Artificial Sequence
  gRNA target sequence
gtagatgtggcgggttttag

SEQ ID NO: 2944 - DNA, 20 bp, Artificial Sequence
  gRNA target sequence
ggtagatgtggcgggtttta

SEQ ID NO: 2945 - DNA, 20 bp, Artificial Sequence
  gRNA target sequence
tggtagatgtggcgggtttt

SEQ ID NO: 2946 - DNA, 20 bp, Artificial Sequence
  gRNA target sequence
agggtgatggtagatgtggc

SEQ ID NO: 2947 - DNA, 20 bp, Artificial Sequence
  gRNA target sequence
gagggtgatggtagatgtgg

SEQ ID NO: 2948 - DNA, 20 bp, Artificial Sequence
  gRNA target sequence
gtagagggtgatggtagatg

SEQ ID NO: 2949 - DNA, 20 bp, Artificial Sequence
  gRNA target sequence
ggcggtgatgtagagggtga

SEQ ID NO: 2950 - DNA, 20 bp, Artificial Sequence
  gRNA target sequence
ggtcggggcggtgatgtaga

SEQ ID NO: 2951 - DNA, 20 bp, Artificial Sequence
  gRNA target sequence
aggtcggggcggtgatgtag

SEQ ID NO: 2952 - DNA, 20 bp, Artificial Sequence
  gRNA target sequence
ggtgagagctaaggtcgggg

SEQ ID NO: 2953 - DNA, 20 bp, Artificial Sequence
  gRNA target sequence
gatggtgagagctaaggtcg

SEQ ID NO: 2954 - DNA, 20 bp, Artificial Sequence
  gRNA target sequence
cgatggtgagagctaaggtc

SEQ ID NO: 2955 - DNA, 20 bp, Artificial Sequence
  gRNA target sequence
gcgatggtgagagctaaggt

SEQ ID NO: 2956 - DNA, 20 bp, Artificial Sequence
  gRNA target sequence
aagagcgatggtgagagcta

SEQ ID NO: 2957 - DNA, 20 bp, Artificial Sequence
  gRNA target sequence
ggttcatagtagaagagcga

SEQ ID NO: 2958 - DNA, 20 bp, Artificial Sequence
  gRNA target sequence
ggggttgggtatggggaggg

SEQ ID NO: 2959 - DNA, 20 bp, Artificial Sequence
  gRNA target sequence
gggggttgggtatggggagg

SEQ ID NO: 2960 - DNA, 20 bp, Artificial Sequence
  gRNA target sequence
agggggttgggtatggggag

SEQ ID NO: 2961 - DNA, 20 bp, Artificial Sequence
  gRNA target sequence
cagggggttgggtatgggga

SEQ ID NO: 2962 - DNA, 20 bp, Artificial Sequence
  gRNA target sequence
ccagggggttgggtatgggg

SEQ ID NO: 2963 - DNA, 20 bp, Artificial Sequence
  gRNA target sequence
tgaccagggggttgggtatg

SEQ ID NO: 2964 - DNA, 20 bp, Artificial Sequence
  gRNA target sequence
ttgaccagggggttgggtat

SEQ ID NO: 2965 - DNA, 20 bp, Artificial Sequence
  gRNA target sequence
gttgaccagggggttgggta

SEQ ID NO: 2966 - DNA, 20 bp, Artificial Sequence
  gRNA target sequence
ttgaggttgaccagggggtt

SEQ ID NO: 2967 - DNA, 20 bp, Artificial Sequence
  gRNA target sequence
gttgaggttgaccagggggt

SEQ ID NO: 2968 - DNA, 20 bp, Artificial Sequence
  gRNA target sequence
ctaggttgaggttgaccagg

SEQ ID NO: 2969 - DNA, 20 bp, Artificial Sequence
  gRNA target sequence
cctaggttgaggttgaccag

SEQ ID NO: 2970 - DNA, 20 bp, Artificial Sequence
  gRNA target sequence
gcctaggttgaggttgacca

SEQ ID NO: 2971 - DNA, 20 bp, Artificial Sequence
  gRNA target sequence
ggcctaggttgaggttgacc

SEQ ID NO: 2972 - DNA, 20 bp, Artificial Sequence
  gRNA target sequence
taaataggaggcctaggttg

SEQ ID NO: 2973 - DNA, 20 bp, Artificial Sequence
  gRNA target sequence
ctagaataaataggaggcct

SEQ ID NO: 2974 - DNA, 20 bp, Artificial Sequence
  gRNA target sequence
aggtggctagaataaatagg

SEQ ID NO: 2975 - DNA, 20 bp, Artificial Sequence
  gRNA target sequence
tagaggtggctagaataaat

SEQ ID NO: 2976 - DNA, 20 bp, Artificial Sequence
  gRNA target sequence
gtaaacggctaggctagagg

SEQ ID NO: 2977 - DNA, 20 bp, Artificial Sequence
  gRNA target sequence
tgagtaaacggctaggctag

SEQ ID NO: 2978 - DNA, 20 bp, Artificial Sequence
  gRNA target sequence
agaggattgagtaaacggct

SEQ ID NO: 2979 - DNA, 20 bp, Artificial Sequence
  gRNA target sequence
tgatcagaggattgagtaaa

SEQ ID NO: 2980 - DNA, 20 bp, Artificial Sequence
  gRNA target sequence
ttgatgctcaccctgatcag

SEQ ID NO: 2981 - DNA, 20 bp, Artificial Sequence
  gRNA target sequence
tgctcgcagtgcgccgatca

SEQ ID NO: 2982 - DNA, 20 bp, Artificial Sequence
  gRNA target sequence
ctgctcgcagtgcgccgatc

SEQ ID NO: 2983 - DNA, 20 bp, Artificial Sequence
  gRNA target sequence
gacttcatatgagattgttt

SEQ ID NO: 2984 - DNA, 20 bp, Artificial Sequence
  gRNA target sequence
tgacttcatatgagattgtt

SEQ ID NO: 2985 - DNA, 20 bp, Artificial Sequence
  gRNA target sequence
tgatagtagaatgatggcta

SEQ ID NO: 2986 - DNA, 20 bp, Artificial Sequence
  gRNA target sequence
ttgatagtagaatgatggct

SEQ ID NO: 2987 - DNA, 20 bp, Artificial Sequence
  gRNA target sequence
taatgttgatagtagaatga

SEQ ID NO: 2988 - DNA, 20 bp, Artificial Sequence
  gRNA target sequence
gataagggtggagaggttaa

SEQ ID NO: 2989 - DNA, 20 bp, Artificial Sequence
  gRNA target sequence
gtgttgtgataagggtggag

SEQ ID NO: 2990 - DNA, 20 bp, Artificial Sequence
  gRNA target sequence
ttcttgtgttgtgataaggg

SEQ ID NO: 2991 - DNA, 20 bp, Artificial Sequence
  gRNA target sequence
gtgttcttgtgttgtgataa

SEQ ID NO: 2992 - DNA, 20 bp, Artificial Sequence
  gRNA target sequence
ggtgttcttgtgttgtgata

SEQ ID NO: 2993 - DNA, 20 bp, Artificial Sequence
  gRNA target sequence
atgatggcaggagtaatcag

SEQ ID NO: 2994 - DNA, 20 bp, Artificial Sequence
  gRNA target sequence
tggccaagggtcatgatggc

SEQ ID NO: 2995 - DNA, 20 bp, Artificial Sequence
  gRNA target sequence
attatggccaagggtcatga

SEQ ID NO: 2996 - DNA, 20 bp, Artificial Sequence
  gRNA target sequence
ataaatcatattatggccaa

SEQ ID NO: 2997 - DNA, 20 bp, Artificial Sequence
  gRNA target sequence
gataaatcatattatggcca

SEQ ID NO: 2998 - DNA, 20 bp, Artificial Sequence
  gRNA target sequence
tgtggagataaatcatatta

SEQ ID NO: 2999 - DNA, 20 bp, Artificial Sequence
  gRNA target sequence
tcggttggtctctgctagtg

SEQ ID NO: 3000 - DNA, 20 bp, Artificial Sequence
  gRNA target sequence
aaggtcgaagggggttcggt

SEQ ID NO: 3001 - DNA, 20 bp, Artificial Sequence
  gRNA target sequence
cggcaaggtcgaagggggtt

SEQ ID NO: 3002 - DNA, 20 bp, Artificial Sequence
  gRNA target sequence
cccttcggcaaggtcgaagg

SEQ ID NO: 3003 - DNA, 20 bp, Artificial Sequence
  gRNA target sequence
ccccttcggcaaggtcgaag

SEQ ID NO: 3004 - DNA, 20 bp, Artificial Sequence
  gRNA target sequence
tccccttcggcaaggtcgaa

SEQ ID NO: 3005 - DNA, 20 bp, Artificial Sequence
  gRNA target sequence
ctccccttcggcaaggtcga

SEQ ID NO: 3006 - DNA, 20 bp, Artificial Sequence
  gRNA target sequence
gttcggactccccttcggca

SEQ ID NO: 3007 - DNA, 20 bp, Artificial Sequence
  gRNA target sequence
gactagttcggactcccctt

SEQ ID NO: 3008 - DNA, 20 bp, Artificial Sequence
  gRNA target sequence
gttgaagcctgagactagtt

SEQ ID NO: 3009 - DNA, 20 bp, Artificial Sequence
  gRNA target sequence
gaatagggcgaaggggcctg

SEQ ID NO: 3010 - DNA, 20 bp, Artificial Sequence
  gRNA target sequence
ctatgaagaatagggcgaag

SEQ ID NO: 3011 - DNA, 20 bp, Artificial Sequence
  gRNA target sequence
gctatgaagaatagggcgaa

SEQ ID NO: 3012 - DNA, 20 bp, Artificial Sequence
  gRNA target sequence
ggctatgaagaatagggcga

SEQ ID NO: 3013 - DNA, 20 bp, Artificial Sequence
  gRNA target sequence
gtattcggctatgaagaata

SEQ ID NO: 3014 - DNA, 20 bp, Artificial Sequence
  gRNA target sequence
tgtattcggctatgaagaat

SEQ ID NO: 3015 - DNA, 20 bp, Artificial Sequence
  gRNA target sequence
tataataatgtttgtgtatt

SEQ ID NO: 3016 - DNA, 20 bp, Artificial Sequence
  gRNA target sequence
taggaagattgtagtggtga

SEQ ID NO: 3017 - DNA, 20 bp, Artificial Sequence
  gRNA target sequence
ctaggaagattgtagtggtg

SEQ ID NO: 3018 - DNA, 20 bp, Artificial Sequence
  gRNA target sequence
tgttcctaggaagattgtag

SEQ ID NO: 3019 - DNA, 20 bp, Artificial Sequence
  gRNA target sequence
gtgcgtcatatgttgttcct

SEQ ID NO: 3020 - DNA, 20 bp, Artificial Sequence
  gRNA target sequence
atatgttgtgtagagttcag

SEQ ID NO: 3021 - DNA, 20 bp, Artificial Sequence
  gRNA target sequence
aatatgttgtgtagagttca

SEQ ID NO: 3022 - DNA, 20 bp, Artificial Sequence
  gRNA target sequence
aaatatgttgtgtagagttc

SEQ ID NO: 3023 - DNA, 20 bp, Artificial Sequence
  gRNA target sequence
ggaggttagaagtagggtct

SEQ ID NO: 3024 - DNA, 20 bp, Artificial Sequence
  gRNA target sequence
gaacagggaggttagaagta

SEQ ID NO: 3025 - DNA, 20 bp, Artificial Sequence
  gRNA target sequence
agaacagggaggttagaagt

SEQ ID NO: 3026 - DNA, 20 bp, Artificial Sequence
  gRNA target sequence
tcgaattcataagaacaggg

SEQ ID NO: 3027 - DNA, 20 bp, Artificial Sequence
  gRNA target sequence
tgttcgaattcataagaaca

SEQ ID NO: 3028 - DNA, 20 bp, Artificial Sequence
  gRNA target sequence
ctgttcgaattcataagaac

SEQ ID NO: 3029 - DNA, 20 bp, Artificial Sequence
  gRNA target sequence
gttggtcgtagcggaatcgg

SEQ ID NO: 3030 - DNA, 20 bp, Artificial Sequence
  gRNA target sequence
agttggtcgtagcggaatcg

SEQ ID NO: 3031 - DNA, 20 bp, Artificial Sequence
  gRNA target sequence
gagttggtcgtagcggaatc

SEQ ID NO: 3032 - DNA, 20 bp, Artificial Sequence
  gRNA target sequence
tgagttggtcgtagcggaat

SEQ ID NO: 3033 - DNA, 20 bp, Artificial Sequence
  gRNA target sequence
ggtgtatgagttggtcgtag

SEQ ID NO: 3034 - DNA, 20 bp, Artificial Sequence
  gRNA target sequence
ttcataggaggtgtatgagt

SEQ ID NO: 3035 - DNA, 20 bp, Artificial Sequence
  gRNA target sequence
gtaggaagttttttcatagg

SEQ ID NO: 3036 - DNA, 20 bp, Artificial Sequence
  gRNA target sequence
gtggtaggaagttttttcat

SEQ ID NO: 3037 - DNA, 20 bp, Artificial Sequence
  gRNA target sequence
gtaatgctagggtgagtggt

SEQ ID NO: 3038 - DNA, 20 bp, Artificial Sequence
  gRNA target sequence
ataagtaatgctagggtgag

SEQ ID NO: 3039 - DNA, 20 bp, Artificial Sequence
  gRNA target sequence
atatcatataagtaatgcta

SEQ ID NO: 3040 - DNA, 20 bp, Artificial Sequence
  gRNA target sequence
catatcatataagtaatgct

SEQ ID NO: 3041 - DNA, 20 bp, Artificial Sequence
  gRNA target sequence
gctggagattgtaatgggta

SEQ ID NO: 3042 - DNA, 20 bp, Artificial Sequence
  gRNA target sequence
ggaatgctggagattgtaat

SEQ ID NO: 3043 - DNA, 20 bp, Artificial Sequence
  gRNA target sequence
gggaatgctggagattgtaa

SEQ ID NO: 3044 - DNA, 20 bp, Artificial Sequence
  gRNA target sequence
ttaggtttgagggggaatgc

SEQ ID NO: 3045 - DNA, 20 bp, Artificial Sequence
  gRNA target sequence
catatttcttaggtttgagg

SEQ ID NO: 3046 - DNA, 20 bp, Artificial Sequence
  gRNA target sequence
acatatttcttaggtttgag

SEQ ID NO: 3047 - DNA, 20 bp, Artificial Sequence
  gRNA target sequence
gacatatttcttaggtttga

SEQ ID NO: 3048 - DNA, 20 bp, Artificial Sequence
  gRNA target sequence
agacatatttcttaggtttg

SEQ ID NO: 3049 - DNA, 20 bp, Artificial Sequence
  gRNA target sequence
ttttatcagacatatttctt

SEQ ID NO: 3050 - DNA, 20 bp, Artificial Sequence
  gRNA target sequence
tcatagtcctagaaataagg

SEQ ID NO: 3051 - DNA, 20 bp, Artificial Sequence
  gRNA target sequence
ctcatagtcctagaaataag

SEQ ID NO: 3052 - DNA, 20 bp, Artificial Sequence
  gRNA target sequence
tctcatagtcctagaaataa

SEQ ID NO: 3053 - DNA, 20 bp, Artificial Sequence
  gRNA target sequence
ttctcatagtcctagaaata

SEQ ID NO: 3054 - DNA, 20 bp, Artificial Sequence
  gRNA target sequence
aattttggattctcagggat

SEQ ID NO: 3055 - DNA, 20 bp, Artificial Sequence
  gRNA target sequence
gaattttggattctcaggga

SEQ ID NO: 3056 - DNA, 20 bp, Artificial Sequence
  gRNA target sequence
cggagaattttggattctca

SEQ ID NO: 3057 - DNA, 20 bp, Artificial Sequence
  gRNA target sequence
acggagaattttggattctc

SEQ ID NO: 3058 - DNA, 20 bp, Artificial Sequence
  gRNA target sequence
ataggtggcacggagaattt

SEQ ID NO: 3059 - DNA, 20 bp, Artificial Sequence
  gRNA target sequence
atggggtgtgataggtggca

SEQ ID NO: 3060 - DNA, 20 bp, Artificial Sequence
  gRNA target sequence
ttaggatggggtgtgatagg

SEQ ID NO: 3061 - DNA, 20 bp, Artificial Sequence
  gRNA target sequence
actttaggatggggtgtgat

SEQ ID NO: 3062 - DNA, 20 bp, Artificial Sequence
  gRNA target sequence
gctgaccttactttaggatg

SEQ ID NO: 3063 - DNA, 20 bp, Artificial Sequence
  gRNA target sequence
agctgaccttactttaggat

SEQ ID NO: 3064 - DNA, 20 bp, Artificial Sequence
  gRNA target sequence
tagctgaccttactttagga

SEQ ID NO: 3065 - DNA, 20 bp, Artificial Sequence
  gRNA target sequence
tatttagctgaccttacttt

SEQ ID NO: 3066 - DNA, 20 bp, Artificial Sequence
  gRNA target sequence
aaccaacattttcggggtat

SEQ ID NO: 3067 - DNA, 20 bp, Artificial Sequence
  gRNA target sequence
taaccaacattttcggggta

SEQ ID NO: 3068 - DNA, 20 bp, Artificial Sequence
  gRNA target sequence
gggtataaccaacattttcg

SEQ ID NO: 3069 - DNA, 20 bp, Artificial Sequence
  gRNA target sequence
agggtataaccaacattttc

SEQ ID NO: 3070 - DNA, 20 bp, Artificial Sequence
  gRNA target sequence
aagggtataaccaacatttt

SEQ ID NO: 3071 - DNA, 20 bp, Artificial Sequence
  gRNA target sequence
gggattaattagtacgggaa

SEQ ID NO: 3072 - DNA, 20 bp, Artificial Sequence
  gRNA target sequence
ggggattaattagtacggga

SEQ ID NO: 3073 - DNA, 20 bp, Artificial Sequence
  gRNA target sequence
gccaggggattaattagtac

SEQ ID NO: 3074 - DNA, 20 bp, Artificial Sequence
  gRNA target sequence
ggccaggggattaattagta

SEQ ID NO: 3075 - DNA, 20 bp, Artificial Sequence
  gRNA target sequence
tagatgacgggttgggccag

SEQ ID NO: 3076 - DNA, 20 bp, Artificial Sequence
  gRNA target sequence
gtagatgacgggttgggcca

SEQ ID NO: 3077 - DNA, 20 bp, Artificial Sequence
  gRNA target sequence
agtagatgacgggttgggcc

SEQ ID NO: 3078 - DNA, 20 bp, Artificial Sequence
  gRNA target sequence
ggtagagtagatgacgggtt

SEQ ID NO: 3079 - DNA, 20 bp, Artificial Sequence
  gRNA target sequence
tggtagagtagatgacgggt

SEQ ID NO: 3080 - DNA, 20 bp, Artificial Sequence
  gRNA target sequence
aagatggtagagtagatgac

SEQ ID NO: 3081 - DNA, 20 bp, Artificial Sequence
  gRNA target sequence
aaagatggtagagtagatga

SEQ ID NO: 3082 - DNA, 20 bp, Artificial Sequence
  gRNA target sequence
gatgagtgtgcctgcaaaga

SEQ ID NO: 3083 - DNA, 20 bp, Artificial Sequence
  gRNA target sequence
gtttatttctaggcctactc

SEQ ID NO: 3084 - DNA, 20 bp, Artificial Sequence
  gRNA target sequence
aagctagcatgtttatttct

SEQ ID NO: 3085 - DNA, 20 bp, Artificial Sequence
  gRNA target sequence
tttatttttttggttagaac

SEQ ID NO: 3086 - DNA, 20 bp, Artificial Sequence
  gRNA target sequence
ggaacgagggtttatttttt

SEQ ID NO: 3087 - DNA, 20 bp, Artificial Sequence
  gRNA target sequence
tggcagcttctgtggaacga

SEQ ID NO: 3088 - DNA, 20 bp, Artificial Sequence
  gRNA target sequence
atggcagcttctgtggaacg

SEQ ID NO: 3089 - DNA, 20 bp, Artificial Sequence
  gRNA target sequence
atacttgatggcagcttctg

SEQ ID NO: 3090 - DNA, 20 bp, Artificial Sequence
  gRNA target sequence
ttgcgtgaggaaatacttga

SEQ ID NO: 3091 - DNA, 20 bp, Artificial Sequence
  gRNA target sequence
tggatgcggttgcttgcgtg

SEQ ID NO: 3092 - DNA, 20 bp, Artificial Sequence
  gRNA target sequence
tattagaaggattatggatg

SEQ ID NO: 3093 - DNA, 20 bp, Artificial Sequence
  gRNA target sequence
gatagctattagaaggatta

SEQ ID NO: 3094 - DNA, 20 bp, Artificial Sequence
  gRNA target sequence
tgaagaggatagctattaga

SEQ ID NO: 3095 - DNA, 20 bp, Artificial Sequence
  gRNA target sequence
cggagagtatattgttgaag

SEQ ID NO: 3096 - DNA, 20 bp, Artificial Sequence
  gRNA target sequence
attggttatggttcattgtc

SEQ ID NO: 3097 - DNA, 20 bp, Artificial Sequence
  gRNA target sequence
ttgattggtagtattggtta

SEQ ID NO: 3098 - DNA, 20 bp, Artificial Sequence
  gRNA target sequence
tgagtattgattggtagtat

SEQ ID NO: 3099 - DNA, 20 bp, Artificial Sequence
  gRNA target sequence
tattaatgatgagtattgat

SEQ ID NO: 3100 - DNA, 20 bp, Artificial Sequence
  gRNA target sequence
tgggactcagaagtgaaagg

SEQ ID NO: 3101 - DNA, 20 bp, Artificial Sequence
  gRNA target sequence
ctgggactcagaagtgaaag

SEQ ID NO: 3102 - DNA, 20 bp, Artificial Sequence
  gRNA target sequence
tctgggactcagaagtgaaa

SEQ ID NO: 3103 - DNA, 20 bp, Artificial Sequence
  gRNA target sequence
ctctgggactcagaagtgaa

SEQ ID NO: 3104 - DNA, 20 bp, Artificial Sequence
  gRNA target sequence
gggtgccttgggtaacctct

SEQ ID NO: 3105 - DNA, 20 bp, Artificial Sequence
  gRNA target sequence
ggggtgccttgggtaacctc

SEQ ID NO: 3106 - DNA, 20 bp, Artificial Sequence
  gRNA target sequence
ggatgtcagaggggtgcctt

SEQ ID NO: 3107 - DNA, 20 bp, Artificial Sequence
  gRNA target sequence
cggatgtcagaggggtgcct

SEQ ID NO: 3108 - DNA, 20 bp, Artificial Sequence
  gRNA target sequence
aagcaggccggatgtcagag

SEQ ID NO: 3109 - DNA, 20 bp, Artificial Sequence
  gRNA target sequence
gaagcaggccggatgtcaga

SEQ ID NO: 3110 - DNA, 20 bp, Artificial Sequence
  gRNA target sequence
agaagcaggccggatgtcag

SEQ ID NO: 3111 - DNA, 20 bp, Artificial Sequence
  gRNA target sequence
tcatgtgagaagaagcaggc

SEQ ID NO: 3112 - DNA, 20 bp, Artificial Sequence
  gRNA target sequence
tttgtcatgtgagaagaagc

SEQ ID NO: 3113 - DNA, 20 bp, Artificial Sequence
  gRNA target sequence
ttggtatatgattgagatgg

SEQ ID NO: 3114 - DNA, 20 bp, Artificial Sequence
  gRNA target sequence
tttggtatatgattgagatg

SEQ ID NO: 3115 - DNA, 20 bp, Artificial Sequence
  gRNA target sequence
atttggtatatgattgagat

SEQ ID NO: 3116 - DNA, 20 bp, Artificial Sequence
  gRNA target sequence
gatttggtatatgattgaga

SEQ ID NO: 3117 - DNA, 20 bp, Artificial Sequence
  gRNA target sequence
cgtttagtgagggagagatt

SEQ ID NO: 3118 - DNA, 20 bp, Artificial Sequence
  gRNA target sequence
agaaggcttacgtttagtga

SEQ ID NO: 3119 - DNA, 20 bp, Artificial Sequence
  gRNA target sequence
gagaaggcttacgtttagtg

SEQ ID NO: 3120 - DNA, 20 bp, Artificial Sequence
  gRNA target sequence
agattgagagagtgaggaga

SEQ ID NO: 3121 - DNA, 20 bp, Artificial Sequence
  gRNA target sequence
tggataagattgagagagtg

SEQ ID NO: 3122 - DNA, 20 bp, Artificial Sequence
  gRNA target sequence
acctcaactgcctgctatga

SEQ ID NO: 3123 - DNA, 20 bp, Artificial Sequence
  gRNA target sequence
agattttgcgtagctgggtt

SEQ ID NO: 3124 - DNA, 20 bp, Artificial Sequence
  gRNA target sequence
tgctaagattttgcgtagct

SEQ ID NO: 3125 - DNA, 20 bp, Artificial Sequence
  gRNA target sequence
atgctaagattttgcgtagc

SEQ ID NO: 3126 - DNA, 20 bp, Artificial Sequence
  gRNA target sequence
tcatcctatgtgggtaattg

SEQ ID NO: 3127 - DNA, 20 bp, Artificial Sequence
  gRNA target sequence
tgctattattcatcctatgt

SEQ ID NO: 3128 - DNA, 20 bp, Artificial Sequence
  gRNA target sequence
ctgctattattcatcctatg

SEQ ID NO: 3129 - DNA, 20 bp, Artificial Sequence
  gRNA target sequence
atggttatgttagggttgta

SEQ ID NO: 3130 - DNA, 20 bp, Artificial Sequence
  gRNA target sequence
aattaagaatggttatgtta

SEQ ID NO: 3131 - DNA, 20 bp, Artificial Sequence
  gRNA target sequence
aaattaagaatggttatgtt

SEQ ID NO: 3132 - DNA, 20 bp, Artificial Sequence
  gRNA target sequence
ataaatagttaaattaagaa

SEQ ID NO: 3133 - DNA, 20 bp, Artificial Sequence
  gRNA target sequence
gtaggaatgcggtagtagtt

SEQ ID NO: 3134 - DNA, 20 bp, Artificial Sequence
  gRNA target sequence
taagttgagtagtaggaatg

SEQ ID NO: 3135 - DNA, 20 bp, Artificial Sequence
  gRNA target sequence
tggagtttaagttgagtagt

SEQ ID NO: 3136 - DNA, 20 bp, Artificial Sequence
  gRNA target sequence
tagtagtagggtcgtggtgc

SEQ ID NO: 3137 - DNA, 20 bp, Artificial Sequence
  gRNA target sequence
gcgagatagtagtagggtcg

SEQ ID NO: 3138 - DNA, 20 bp, Artificial Sequence
  gRNA target sequence
tcaggtgcgagatagtagta

SEQ ID NO: 3139 - DNA, 20 bp, Artificial Sequence
  gRNA target sequence
ttcaggtgcgagatagtagt

SEQ ID NO: 3140 - DNA, 20 bp, Artificial Sequence
  gRNA target sequence
tagtcatgttagcttgtttc

SEQ ID NO: 3141 - DNA, 20 bp, Artificial Sequence
  gRNA target sequence
aggagggtggatggaattaa

SEQ ID NO: 3142 - DNA, 20 bp, Artificial Sequence
  gRNA target sequence
gaggagggtggatggaatta

SEQ ID NO: 3143 - DNA, 20 bp, Artificial Sequence
  gRNA target sequence
cctagggagaggagggtgga

SEQ ID NO: 3144 - DNA, 20 bp, Artificial Sequence
  gRNA target sequence
gcctcctagggagaggaggg

SEQ ID NO: 3145 - DNA, 20 bp, Artificial Sequence
  gRNA target sequence
caggcctcctagggagagga

SEQ ID NO: 3146 - DNA, 20 bp, Artificial Sequence
  gRNA target sequence
gcaggcctcctagggagagg

SEQ ID NO: 3147 - DNA, 20 bp, Artificial Sequence
  gRNA target sequence
ggggcaggcctcctagggag

SEQ ID NO: 3148 - DNA, 20 bp, Artificial Sequence
  gRNA target sequence
tagcgggggcaggcctccta

SEQ ID NO: 3149 - DNA, 20 bp, Artificial Sequence
  gRNA target sequence
ttagcgggggcaggcctcct

SEQ ID NO: 3150 - DNA, 20 bp, Artificial Sequence
  gRNA target sequence
aaaagccggttagcgggggc

SEQ ID NO: 3151 - DNA, 20 bp, Artificial Sequence
  gRNA target sequence
ggcaaaaagccggttagcgg

SEQ ID NO: 3152 - DNA, 20 bp, Artificial Sequence
  gRNA target sequence
gggcaaaaagccggttagcg

SEQ ID NO: 3153 - DNA, 20 bp, Artificial Sequence
  gRNA target sequence
tgggcaaaaagccggttagc

SEQ ID NO: 3154 - DNA, 20 bp, Artificial Sequence
  gRNA target sequence
ttgggcaaaaagccggttag

SEQ ID NO: 3155 - DNA, 20 bp, Artificial Sequence
  gRNA target sequence
ggcccatttgggcaaaaagc

SEQ ID NO: 3156 - DNA, 20 bp, Artificial Sequence
  gRNA target sequence
tcttcgataatggcccattt

SEQ ID NO: 3157 - DNA, 20 bp, Artificial Sequence
  gRNA target sequence
ttcttcgataatggcccatt

SEQ ID NO: 3158 - DNA, 20 bp, Artificial Sequence
  gRNA target sequence
ttttgtgaattcttcgataa

SEQ ID NO: 3159 - DNA, 20 bp, Artificial Sequence
  gRNA target sequence
ctatgatggtggggatgatg

SEQ ID NO: 3160 - DNA, 20 bp, Artificial Sequence
  gRNA target sequence
tgatggtggctatgatggtg

SEQ ID NO: 3161 - DNA, 20 bp, Artificial Sequence
  gRNA target sequence
gtgatggtggctatgatggt

SEQ ID NO: 3162 - DNA, 20 bp, Artificial Sequence
  gRNA target sequence
ggtgatggtggctatgatgg

SEQ ID NO: 3163 - DNA, 20 bp, Artificial Sequence
  gRNA target sequence
gagggtgatggtggctatga

SEQ ID NO: 3164 - DNA, 20 bp, Artificial Sequence
  gRNA target sequence
gaggttaaggagggtgatgg

SEQ ID NO: 3165 - DNA, 20 bp, Artificial Sequence
  gRNA target sequence
gtagaggttaaggagggtga

SEQ ID NO: 3166 - DNA, 20 bp, Artificial Sequence
  gRNA target sequence
gtagaagtagaggttaagga

SEQ ID NO: 3167 - DNA, 20 bp, Artificial Sequence
  gRNA target sequence
ggtagaagtagaggttaagg

SEQ ID NO: 3168 - DNA, 20 bp, Artificial Sequence
  gRNA target sequence
gtaggtagaagtagaggtta

SEQ ID NO: 3169 - DNA, 20 bp, Artificial Sequence
  gRNA target sequence
ttaggcgtaggtagaagtag

SEQ ID NO: 3170 - DNA, 20 bp, Artificial Sequence
  gRNA target sequence
aggtggagtagattaggcgt

SEQ ID NO: 3171 - DNA, 20 bp, Artificial Sequence
  gRNA target sequence
tgattgaggtggagtagatt

SEQ ID NO: 3172 - DNA, 20 bp, Artificial Sequence
  gRNA target sequence
ggggagtagtgtgattgagg

SEQ ID NO: 3173 - DNA, 20 bp, Artificial Sequence
  gRNA target sequence
tatggggagtagtgtgattg

SEQ ID NO: 3174 - DNA, 20 bp, Artificial Sequence
  gRNA target sequence
tttttacgttgttagatatg

SEQ ID NO: 3175 - DNA, 20 bp, Artificial Sequence
  gRNA target sequence
atttttacgttgttagatat

SEQ ID NO: 3176 - DNA, 20 bp, Artificial Sequence
  gRNA target sequence
tatttttacgttgttagata

SEQ ID NO: 3177 - DNA, 20 bp, Artificial Sequence
  gRNA target sequence
agtgtggggaggaatggggt

SEQ ID NO: 3178 - DNA, 20 bp, Artificial Sequence
  gRNA target sequence
gagtgtggggaggaatgggg

SEQ ID NO: 3179 - DNA, 20 bp, Artificial Sequence
  gRNA target sequence
gatgagtgtggggaggaatg

SEQ ID NO: 3180 - DNA, 20 bp, Artificial Sequence
  gRNA target sequence
cgatgagtgtggggaggaat

SEQ ID NO: 3181 - DNA, 20 bp, Artificial Sequence
  gRNA target sequence
gcgatgagtgtggggaggaa

SEQ ID NO: 3182 - DNA, 20 bp, Artificial Sequence
  gRNA target sequence
taagggcgatgagtgtgggg

SEQ ID NO: 3183 - DNA, 20 bp, Artificial Sequence
  gRNA target sequence
tggtaagggcgatgagtgtg

SEQ ID NO: 3184 - DNA, 20 bp, Artificial Sequence
  gRNA target sequence
gtggtaagggcgatgagtgt

SEQ ID NO: 3185 - DNA, 20 bp, Artificial Sequence
  gRNA target sequence
cgtggtaagggcgatgagtg

SEQ ID NO: 3186 - DNA, 20 bp, Artificial Sequence
  gRNA target sequence
aggtaggagtagcgtggtaa

SEQ ID NO: 3187 - DNA, 20 bp, Artificial Sequence
  gRNA target sequence
taggtaggagtagcgtggta

SEQ ID NO: 3188 - DNA, 20 bp, Artificial Sequence
  gRNA target sequence
ggagataggtaggagtagcg

SEQ ID NO: 3189 - DNA, 20 bp, Artificial Sequence
  gRNA target sequence
gtataaaaggggagataggt

SEQ ID NO: 3190 - DNA, 20 bp, Artificial Sequence
  gRNA target sequence
attagtataaaaggggagat

SEQ ID NO: 3191 - DNA, 20 bp, Artificial Sequence
  gRNA target sequence
taagattattagtataaaag

SEQ ID NO: 3192 - DNA, 20 bp, Artificial Sequence
  gRNA target sequence
ataagattattagtataaaa

SEQ ID NO: 3193 - DNA, 20 bp, Artificial Sequence
  gRNA target sequence
tataagattattagtataaa

SEQ ID NO: 3194 - DNA, 20 bp, Artificial Sequence
  gRNA target sequence
ctgagggctttgaaggctct

SEQ ID NO: 3195 - DNA, 20 bp, Artificial Sequence
  gRNA target sequence
caacttactgagggctttga

SEQ ID NO: 3196 - DNA, 20 bp, Artificial Sequence
  gRNA target sequence
taagtattgcaacttactga

SEQ ID NO: 3197 - DNA, 20 bp, Artificial Sequence
  gRNA target sequence
ttaagtattgcaacttactg

SEQ ID NO: 3198 - DNA, 20 bp, Artificial Sequence
  gRNA target sequence
cgttcagttgatgcagagtg

SEQ ID NO: 3199 - DNA, 20 bp, Artificial Sequence
  gRNA target sequence
gcgttcagttgatgcagagt

SEQ ID NO: 3200 - DNA, 20 bp, Artificial Sequence
  gRNA target sequence
tgcgttcagttgatgcagag

SEQ ID NO: 3201 - DNA, 20 bp, Artificial Sequence
  gRNA target sequence
agggcttagcttaattaaag

SEQ ID NO: 3202 - DNA, 20 bp, Artificial Sequence
  gRNA target sequence
aagtcccattggtctagtaa

SEQ ID NO: 3203 - DNA, 20 bp, Artificial Sequence
  gRNA target sequence
taagtcccattggtctagta

SEQ ID NO: 3204 - DNA, 20 bp, Artificial Sequence
  gRNA target sequence
tttgtgggtttaagtcccat

SEQ ID NO: 3205 - DNA, 20 bp, Artificial Sequence
  gRNA target sequence
gctgttaactaagtgtttgt

SEQ ID NO: 3206 - DNA, 20 bp, Artificial Sequence
  gRNA target sequence
agctgttaactaagtgtttg

SEQ ID NO: 3207 - DNA, 20 bp, Artificial Sequence
  gRNA target sequence
agattgaagccagttgatta

SEQ ID NO: 3208 - DNA, 20 bp, Artificial Sequence
  gRNA target sequence
tagattgaagccagttgatt

SEQ ID NO: 3209 - DNA, 20 bp, Artificial Sequence
  gRNA target sequence
ccgccttttttcccggcggc

SEQ ID NO: 3210 - DNA, 20 bp, Artificial Sequence
  gRNA target sequence
cccgccttttttcccggcgg

SEQ ID NO: 3211 - DNA, 20 bp, Artificial Sequence
  gRNA target sequence
tctcccgccttttttcccgg

SEQ ID NO: 3212 - DNA, 20 bp, Artificial Sequence
  gRNA target sequence
gcttctcccgccttttttcc

SEQ ID NO: 3213 - DNA, 20 bp, Artificial Sequence
  gRNA target sequence
aagcagcttcaaacctgccg

SEQ ID NO: 3214 - DNA, 20 bp, Artificial Sequence
  gRNA target sequence
gaagcagcttcaaacctgcc

SEQ ID NO: 3215 - DNA, 20 bp, Artificial Sequence
  gRNA target sequence
agaagcagcttcaaacctgc

SEQ ID NO: 3216 - DNA, 20 bp, Artificial Sequence
  gRNA target sequence
gcctctttttaccagctccg

SEQ ID NO: 3217 - DNA, 20 bp, Artificial Sequence
  gRNA target sequence
taaatctaaagacaggggtt

SEQ ID NO: 3218 - DNA, 20 bp, Artificial Sequence
  gRNA target sequence
gactgtaaatctaaagacag

SEQ ID NO: 3219 - DNA, 20 bp, Artificial Sequence
  gRNA target sequence
ggactgtaaatctaaagaca

SEQ ID NO: 3220 - DNA, 20 bp, Artificial Sequence
  gRNA target sequence
tggactgtaaatctaaagac

SEQ ID NO: 3221 - DNA, 20 bp, Artificial Sequence
  gRNA target sequence
aaaatggctgagtgaagcat

SEQ ID NO: 3222 - DNA, 20 bp, Artificial Sequence
  gRNA target sequence
tcagtgggggtgaggtaaaa

SEQ ID NO: 3223 - DNA, 20 bp, Artificial Sequence
  gRNA target sequence
ggcgaacatcagtgggggtg

SEQ ID NO: 3224 - DNA, 20 bp, Artificial Sequence
  gRNA target sequence
cggtcggcgaacatcagtgg

SEQ ID NO: 3225 - DNA, 20 bp, Artificial Sequence
  gRNA target sequence
acggtcggcgaacatcagtg

SEQ ID NO: 3226 - DNA, 20 bp, Artificial Sequence
  gRNA target sequence
aacggtcggcgaacatcagt

SEQ ID NO: 3227 - DNA, 20 bp, Artificial Sequence
  gRNA target sequence
caacggtcggcgaacatcag

SEQ ID NO: 3228 - DNA, 20 bp, Artificial Sequence
  gRNA target sequence
tgtagagaatagtcaacggt

SEQ ID NO: 3229 - DNA, 20 bp, Artificial Sequence
  gRNA target sequence
ggtttgtagagaatagtcaa

SEQ ID NO: 3230 - DNA, 20 bp, Artificial Sequence
  gRNA target sequence
atagtgttccaatgtctttg

SEQ ID NO: 3231 - DNA, 20 bp, Artificial Sequence
  gRNA target sequence
cagctcatgcgccgaataat

SEQ ID NO: 3232 - DNA, 20 bp, Artificial Sequence
  gRNA target sequence
ggaggcttagagctgtgcct

SEQ ID NO: 3233 - DNA, 20 bp, Artificial Sequence
  gRNA target sequence
ccagctcggctcgaataagg

SEQ ID NO: 3234 - DNA, 20 bp, Artificial Sequence
  gRNA target sequence
ggcccagctcggctcgaata

SEQ ID NO: 3235 - DNA, 20 bp, Artificial Sequence
  gRNA target sequence
gttgcctggctggcccagct

SEQ ID NO: 3236 - DNA, 20 bp, Artificial Sequence
  gRNA target sequence
tacctagaaggttgcctggc

SEQ ID NO: 3237 - DNA, 20 bp, Artificial Sequence
  gRNA target sequence
tcgttacctagaaggttgcc

SEQ ID NO: 3238 - DNA, 20 bp, Artificial Sequence
  gRNA target sequence
agatgtggtcgttacctaga

SEQ ID NO: 3239 - DNA, 20 bp, Artificial Sequence
  gRNA target sequence
tgacgataacgttgtagatg

SEQ ID NO: 3240 - DNA, 20 bp, Artificial Sequence
  gRNA target sequence
gaagattattacaaatgcat

SEQ ID NO: 3241 - DNA, 20 bp, Artificial Sequence
  gRNA target sequence
agaagattattacaaatgca

SEQ ID NO: 3242 - DNA, 20 bp, Artificial Sequence
  gRNA target sequence
ccaaagcctccgattatgat

SEQ ID NO: 3243 - DNA, 20 bp, Artificial Sequence
  gRNA target sequence
gccaaagcctccgattatga

SEQ ID NO: 3244 - DNA, 20 bp, Artificial Sequence
  gRNA target sequence
tcgggggcaccgattattag

SEQ ID NO: 3245 - DNA, 20 bp, Artificial Sequence
  gRNA target sequence
atcgggggcaccgattatta

SEQ ID NO: 3246 - DNA, 20 bp, Artificial Sequence
  gRNA target sequence
tatcgggggcaccgattatt

SEQ ID NO: 3247 - DNA, 20 bp, Artificial Sequence
  gRNA target sequence
gcggggaaacgccatatcgg

SEQ ID NO: 3248 - DNA, 20 bp, Artificial Sequence
  gRNA target sequence
tgcggggaaacgccatatcg

SEQ ID NO: 3249 - DNA, 20 bp, Artificial Sequence
  gRNA target sequence
atgcggggaaacgccatatc

SEQ ID NO: 3250 - DNA, 20 bp, Artificial Sequence
  gRNA target sequence
tatgcggggaaacgccatat

SEQ ID NO: 3251 - DNA, 20 bp, Artificial Sequence
  gRNA target sequence
aagcttatgttgtttatgcg

SEQ ID NO: 3252 - DNA, 20 bp, Artificial Sequence
  gRNA target sequence
gaagcttatgttgtttatgc

SEQ ID NO: 3253 - DNA, 20 bp, Artificial Sequence
  gRNA target sequence
agaagcttatgttgtttatg

SEQ ID NO: 3254 - DNA, 20 bp, Artificial Sequence
  gRNA target sequence
agcaggagtaggagagaggg

SEQ ID NO: 3255 - DNA, 20 bp, Artificial Sequence
  gRNA target sequence
gcgagcaggagtaggagaga

SEQ ID NO: 3256 - DNA, 20 bp, Artificial Sequence
  gRNA target sequence
tgcgagcaggagtaggagag

SEQ ID NO: 3257 - DNA, 20 bp, Artificial Sequence
  gRNA target sequence
tagcagatgcgagcaggagt

SEQ ID NO: 3258 - DNA, 20 bp, Artificial Sequence
  gRNA target sequence
ccactatagcagatgcgagc

SEQ ID NO: 3259 - DNA, 20 bp, Artificial Sequence
  gRNA target sequence
tgttcaacctgttcctgctc

SEQ ID NO: 3260 - DNA, 20 bp, Artificial Sequence
  gRNA target sequence
agtagttccctgctaaggga

SEQ ID NO: 3261 - DNA, 20 bp, Artificial Sequence
  gRNA target sequence
gagtagttccctgctaaggg

SEQ ID NO: 3262 - DNA, 20 bp, Artificial Sequence
  gRNA target sequence
tgggagtagttccctgctaa

SEQ ID NO: 3263 - DNA, 20 bp, Artificial Sequence
  gRNA target sequence
gtgggagtagttccctgcta

SEQ ID NO: 3264 - DNA, 20 bp, Artificial Sequence
  gRNA target sequence
gtctacggaggctccagggt

SEQ ID NO: 3265 - DNA, 20 bp, Artificial Sequence
  gRNA target sequence
ggtctacggaggctccaggg

SEQ ID NO: 3266 - DNA, 20 bp, Artificial Sequence
  gRNA target sequence
ttaggtctacggaggctcca

SEQ ID NO: 3267 - DNA, 20 bp, Artificial Sequence
  gRNA target sequence
gttaggtctacggaggctcc

SEQ ID NO: 3268 - DNA, 20 bp, Artificial Sequence
  gRNA target sequence
gaagatggttaggtctacgg

SEQ ID NO: 3269 - DNA, 20 bp, Artificial Sequence
  gRNA target sequence
ggagaagatggttaggtcta

SEQ ID NO: 3270 - DNA, 20 bp, Artificial Sequence
  gRNA target sequence
ggtgtaaggagaagatggtt

SEQ ID NO: 3271 - DNA, 20 bp, Artificial Sequence
  gRNA target sequence
tgctaggtgtaaggagaaga

SEQ ID NO: 3272 - DNA, 20 bp, Artificial Sequence
  gRNA target sequence
ggagacacctgctaggtgta

SEQ ID NO: 3273 - DNA, 20 bp, Artificial Sequence
  gRNA target sequence
agatagaggagacacctgct

SEQ ID NO: 3274 - DNA, 20 bp, Artificial Sequence
  gRNA target sequence
attgatggcccctaagatag

SEQ ID NO: 3275 - DNA, 20 bp, Artificial Sequence
  gRNA target sequence
aattgttgtgatgaaattga

SEQ ID NO: 3276 - DNA, 20 bp, Artificial Sequence
  gRNA target sequence
tggtattgggttatggcagg

SEQ ID NO: 3277 - DNA, 20 bp, Artificial Sequence
  gRNA target sequence
ttggtattgggttatggcag

SEQ ID NO: 3278 - DNA, 20 bp, Artificial Sequence
  gRNA target sequence
tttggtattgggttatggca

SEQ ID NO: 3279 - DNA, 20 bp, Artificial Sequence
  gRNA target sequence
gtttggtattgggttatggc

SEQ ID NO: 3280 - DNA, 20 bp, Artificial Sequence
  gRNA target sequence
gggcgtttggtattgggtta

SEQ ID NO: 3281 - DNA, 20 bp, Artificial Sequence
  gRNA target sequence
gaagaggggcgtttggtatt

SEQ ID NO: 3282 - DNA, 20 bp, Artificial Sequence
  gRNA target sequence
cgaagaggggcgtttggtat

SEQ ID NO: 3283 - DNA, 20 bp, Artificial Sequence
  gRNA target sequence
atcagacgaagaggggcgtt

SEQ ID NO: 3284 - DNA, 20 bp, Artificial Sequence
  gRNA target sequence
aggacggatcagacgaagag

SEQ ID NO: 3285 - DNA, 20 bp, Artificial Sequence
  gRNA target sequence
taggacggatcagacgaaga

SEQ ID NO: 3286 - DNA, 20 bp, Artificial Sequence
  gRNA target sequence
ttaggacggatcagacgaag

SEQ ID NO: 3287 - DNA, 20 bp, Artificial Sequence
  gRNA target sequence
taggactgctgtgattagga

SEQ ID NO: 3288 - DNA, 20 bp, Artificial Sequence
  gRNA target sequence
gaagtaggactgctgtgatt

SEQ ID NO: 3289 - DNA, 20 bp, Artificial Sequence
  gRNA target sequence
ctgggagagataggagaagt

SEQ ID NO: 3290 - DNA, 20 bp, Artificial Sequence
  gRNA target sequence
cagctaggactgggagagat

SEQ ID NO: 3291 - DNA, 20 bp, Artificial Sequence
  gRNA target sequence
tgatgccagcagctaggact

SEQ ID NO: 3292 - DNA, 20 bp, Artificial Sequence
  gRNA target sequence
gtgatgccagcagctaggac

SEQ ID NO: 3293 - DNA, 20 bp, Artificial Sequence
  gRNA target sequence
gtatagtgatgccagcagct

SEQ ID NO: 3294 - DNA, 20 bp, Artificial Sequence
  gRNA target sequence
agaaggtggtgttgaggttg

SEQ ID NO: 3295 - DNA, 20 bp, Artificial Sequence
  gRNA target sequence
ggtcgaagaaggtggtgttg

SEQ ID NO: 3296 - DNA, 20 bp, Artificial Sequence
  gRNA target sequence
tccggcggggtcgaagaagg

SEQ ID NO: 3297 - DNA, 20 bp, Artificial Sequence
  gRNA target sequence
tcctccggcggggtcgaaga

SEQ ID NO: 3298 - DNA, 20 bp, Artificial Sequence
  gRNA target sequence
tggggtctcctcctccggcg

SEQ ID NO: 3299 - DNA, 20 bp, Artificial Sequence
  gRNA target sequence
atggggtctcctcctccggc

SEQ ID NO: 3300 - DNA, 20 bp, Artificial Sequence
  gRNA target sequence
aatggggtctcctcctccgg

SEQ ID NO: 3301 - DNA, 20 bp, Artificial Sequence
  gRNA target sequence
tagaatggggtctcctcctc

SEQ ID NO: 3302 - DNA, 20 bp, Artificial Sequence
  gRNA target sequence
ataggtgttggtatagaatg

SEQ ID NO: 3303 - DNA, 20 bp, Artificial Sequence
  gRNA target sequence
aataggtgttggtatagaat

SEQ ID NO: 3304 - DNA, 20 bp, Artificial Sequence
  gRNA target sequence
gaataggtgttggtatagaa

SEQ ID NO: 3305 - DNA, 20 bp, Artificial Sequence
  gRNA target sequence
cgaaaaatcagaataggtgt

SEQ ID NO: 3306 - DNA, 20 bp, Artificial Sequence
  gRNA target sequence
ggtgaccgaaaaatcagaat

SEQ ID NO: 3307 - DNA, 20 bp, Artificial Sequence
  gRNA target sequence
ggataagaatataaacttca

SEQ ID NO: 3308 - DNA, 20 bp, Artificial Sequence
  gRNA target sequence
aggataagaatataaacttc

SEQ ID NO: 3309 - DNA, 20 bp, Artificial Sequence
  gRNA target sequence
agattattccgaagcctggt

SEQ ID NO: 3310 - DNA, 20 bp, Artificial Sequence
  gRNA target sequence
tgggagattattccgaagcc

SEQ ID NO: 3311 - DNA, 20 bp, Artificial Sequence
  gRNA target sequence
ggagtagtaagttacaatat

SEQ ID NO: 3312 - DNA, 20 bp, Artificial Sequence
  gRNA target sequence
cggagtagtaagttacaata

SEQ ID NO: 3313 - DNA, 20 bp, Artificial Sequence
  gRNA target sequence
tccaaatggttctttttttc

SEQ ID NO: 3314 - DNA, 20 bp, Artificial Sequence
  gRNA target sequence
accatacctatgtatccaaa

SEQ ID NO: 3315 - DNA, 20 bp, Artificial Sequence
  gRNA target sequence
gtgctcacacgataaaccct

SEQ ID NO: 3316 - DNA, 20 bp, Artificial Sequence
  gRNA target sequence
ctattcctactgtaaatata

SEQ ID NO: 3317 - DNA, 20 bp, Artificial Sequence
  gRNA target sequence
agcgatgattatggtagcgg

SEQ ID NO: 3318 - DNA, 20 bp, Artificial Sequence
  gRNA target sequence
gatagcgatgattatggtag

SEQ ID NO: 3319 - DNA, 20 bp, Artificial Sequence
  gRNA target sequence
ggtggggatagcgatgatta

SEQ ID NO: 3320 - DNA, 20 bp, Artificial Sequence
  gRNA target sequence
taaatactttgacgccggtg

SEQ ID NO: 3321 - DNA, 20 bp, Artificial Sequence
  gRNA target sequence
ctaaatactttgacgccggt

SEQ ID NO: 3322 - DNA, 20 bp, Artificial Sequence
  gRNA target sequence
gctaaatactttgacgccgg

SEQ ID NO: 3323 - DNA, 20 bp, Artificial Sequence
  gRNA target sequence
tcagctaaatactttgacgc

SEQ ID NO: 3324 - DNA, 20 bp, Artificial Sequence
  gRNA target sequence
catattgcttccgtggagtg

SEQ ID NO: 3325 - DNA, 20 bp, Artificial Sequence
  gRNA target sequence
atcatttcatattgcttccg

SEQ ID NO: 3326 - DNA, 20 bp, Artificial Sequence
  gRNA target sequence
gaaaagaaagatgaatccta

SEQ ID NO: 3327 - DNA, 20 bp, Artificial Sequence
  gRNA target sequence
tgaaaagaaagatgaatcct

SEQ ID NO: 3328 - DNA, 20 bp, Artificial Sequence
  gRNA target sequence
aatgccagtcaggccaccta

SEQ ID NO: 3329 - DNA, 20 bp, Artificial Sequence
  gRNA target sequence
ttgctaatacaatgccagtc

SEQ ID NO: 3330 - DNA, 20 bp, Artificial Sequence
  gRNA target sequence
tgataggacatagtggaagt

SEQ ID NO: 3331 - DNA, 20 bp, Artificial Sequence
  gRNA target sequence
ttgataggacatagtggaag

SEQ ID NO: 3332 - DNA, 20 bp, Artificial Sequence
  gRNA target sequence
ctcctattgataggacatag

SEQ ID NO: 3333 - DNA, 20 bp, Artificial Sequence
  gRNA target sequence
caaatacagctcctattgat

SEQ ID NO: 3334 - DNA, 20 bp, Artificial Sequence
  gRNA target sequence
gtgaatgaagcctcctatga

SEQ ID NO: 3335 - DNA, 20 bp, Artificial Sequence
  gRNA target sequence
agggtgtagcctgagaatag

SEQ ID NO: 3336 - DNA, 20 bp, Artificial Sequence
  gRNA target sequence
tagggtgtagcctgagaata

SEQ ID NO: 3337 - DNA, 20 bp, Artificial Sequence
  gRNA target sequence
ctagggtgtagcctgagaat

SEQ ID NO: 3338 - DNA, 20 bp, Artificial Sequence
  gRNA target sequence
tttggcgtaggtttggtcta

SEQ ID NO: 3339 - DNA, 20 bp, Artificial Sequence
  gRNA target sequence
ttttggcgtaggtttggtct

SEQ ID NO: 3340 - DNA, 20 bp, Artificial Sequence
  gRNA target sequence
aatggattttggcgtaggtt

SEQ ID NO: 3341 - DNA, 20 bp, Artificial Sequence
  gRNA target sequence
agtgaaatggattttggcgt

SEQ ID NO: 3342 - DNA, 20 bp, Artificial Sequence
  gRNA target sequence
tatgatagtgaaatggattt

SEQ ID NO: 3343 - DNA, 20 bp, Artificial Sequence
  gRNA target sequence
cgatgaatatgatagtgaaa

SEQ ID NO: 3344 - DNA, 20 bp, Artificial Sequence
  gRNA target sequence
ataggccgagaaagtgttgt

SEQ ID NO: 3345 - DNA, 20 bp, Artificial Sequence
  gRNA target sequence
gataggccgagaaagtgttg

SEQ ID NO: 3346 - DNA, 20 bp, Artificial Sequence
  gRNA target sequence
aacgtcggggcattccggat

SEQ ID NO: 3347 - DNA, 20 bp, Artificial Sequence
  gRNA target sequence
cgagtaacgtcggggcattc

SEQ ID NO: 3348 - DNA, 20 bp, Artificial Sequence
  gRNA target sequence
gggtagtccgagtaacgtcg

SEQ ID NO: 3349 - DNA, 20 bp, Artificial Sequence
  gRNA target sequence
ggggtagtccgagtaacgtc

SEQ ID NO: 3350 - DNA, 20 bp, Artificial Sequence
  gRNA target sequence
cggggtagtccgagtaacgt

SEQ ID NO: 3351 - DNA, 20 bp, Artificial Sequence
  gRNA target sequence
ttcatgtggtgtatgcatcg

SEQ ID NO: 3352 - DNA, 20 bp, Artificial Sequence
  gRNA target sequence
tttcatgtggtgtatgcatc

SEQ ID NO: 3353 - DNA, 20 bp, Artificial Sequence
  gRNA target sequence
gtttcatgtggtgtatgcat

SEQ ID NO: 3354 - DNA, 20 bp, Artificial Sequence
  gRNA target sequence
agatgataggatgtttcatg

SEQ ID NO: 3355 - DNA, 20 bp, Artificial Sequence
  gRNA target sequence
tgaatgagcctacagatgat

SEQ ID NO: 3356 - DNA, 20 bp, Artificial Sequence
  gRNA target sequence
gacttttcgcttcgaagcga

SEQ ID NO: 3357 - DNA, 20 bp, Artificial Sequence
  gRNA target sequence
tggagggttcttctactatt

SEQ ID NO: 3358 - DNA, 20 bp, Artificial Sequence
  gRNA target sequence
agtcactccaggtttatgga

SEQ ID NO: 3359 - DNA, 20 bp, Artificial Sequence
  gRNA target sequence
tagtcactccaggtttatgg

SEQ ID NO: 3360 - DNA, 20 bp, Artificial Sequence
  gRNA target sequence
atatagtcactccaggttta

SEQ ID NO: 3361 - DNA, 20 bp, Artificial Sequence
  gRNA target sequence
ggcatccatatagtcactcc

SEQ ID NO: 3362 - DNA, 20 bp, Artificial Sequence
  gRNA target sequence
cgaatgtgtggtagggtggg

SEQ ID NO: 3363 - DNA, 20 bp, Artificial Sequence
  gRNA target sequence
tcgaatgtgtggtagggtgg

SEQ ID NO: 3364 - DNA, 20 bp, Artificial Sequence
  gRNA target sequence
ttcgaatgtgtggtagggtg

SEQ ID NO: 3365 - DNA, 20 bp, Artificial Sequence
  gRNA target sequence
cttcgaatgtgtggtagggt

SEQ ID NO: 3366 - DNA, 20 bp, Artificial Sequence
  gRNA target sequence
tcttcgaatgtgtggtaggg

SEQ ID NO: 3367 - DNA, 20 bp, Artificial Sequence
  gRNA target sequence
ggttcttcgaatgtgtggta

SEQ ID NO: 3368 - DNA, 20 bp, Artificial Sequence
  gRNA target sequence
gggttcttcgaatgtgtggt

SEQ ID NO: 3369 - DNA, 20 bp, Artificial Sequence
  gRNA target sequence
atacgggttcttcgaatgtg

SEQ ID NO: 3370 - DNA, 20 bp, Artificial Sequence
  gRNA target sequence
tgtctagattttatgtatac

SEQ ID NO: 3371 - DNA, 20 bp, Artificial Sequence
  gRNA target sequence
ttgtctagattttatgtata

SEQ ID NO: 3372 - DNA, 20 bp, Artificial Sequence
  gRNA target sequence
ggcttgaaaccagctttggg

SEQ ID NO: 3373 - DNA, 20 bp, Artificial Sequence
  gRNA target sequence
tggcttgaaaccagctttgg

SEQ ID NO: 3374 - DNA, 20 bp, Artificial Sequence
  gRNA target sequence
ttggcttgaaaccagctttg

SEQ ID NO: 3375 - DNA, 20 bp, Artificial Sequence
  gRNA target sequence
gttggcttgaaaccagcttt

SEQ ID NO: 3376 - DNA, 20 bp, Artificial Sequence
  gRNA target sequence
ggttggcttgaaaccagctt

SEQ ID NO: 3377 - DNA, 20 bp, Artificial Sequence
  gRNA target sequence
agtcatggaggccatggggt

SEQ ID NO: 3378 - DNA, 20 bp, Artificial Sequence
  gRNA target sequence
aaaaagtcatggaggccatg

SEQ ID NO: 3379 - DNA, 20 bp, Artificial Sequence
  gRNA target sequence
gaaaaagtcatggaggccat

SEQ ID NO: 3380 - DNA, 20 bp, Artificial Sequence
  gRNA target sequence
tgaaaaagtcatggaggcca

SEQ ID NO: 3381 - DNA, 20 bp, Artificial Sequence
  gRNA target sequence
cctttttgaaaaagtcatgg

SEQ ID NO: 3382 - DNA, 20 bp, Artificial Sequence
  gRNA target sequence
atacctttttgaaaaagtca

SEQ ID NO: 3383 - DNA, 20 bp, Artificial Sequence
  gRNA target sequence
actttgacaaagttatgaaa

SEQ ID NO: 3384 - DNA, 20 bp, Artificial Sequence
  gRNA target sequence
catgtgccattaagatatat

SEQ ID NO: 3385 - DNA, 20 bp, Artificial Sequence
  gRNA target sequence
gataagctcttctatgatag

SEQ ID NO: 3386 - DNA, 20 bp, Artificial Sequence
  gRNA target sequence
tgataagctcttctatgata

SEQ ID NO: 3387 - DNA, 20 bp, Artificial Sequence
  gRNA target sequence
gtgataagctcttctatgat

SEQ ID NO: 3388 - DNA, 20 bp, Artificial Sequence
  gRNA target sequence
tatgagggcgtgatcatgaa

SEQ ID NO: 3389 - DNA, 20 bp, Artificial Sequence
  gRNA target sequence
gataaggaaaatgattatga

SEQ ID NO: 3390 - DNA, 20 bp, Artificial Sequence
  gRNA target sequence
agataaggaaaatgattatg

SEQ ID NO: 3391 - DNA, 20 bp, Artificial Sequence
  gRNA target sequence
acaggactaggaagcagata

SEQ ID NO: 3392 - DNA, 20 bp, Artificial Sequence
  gRNA target sequence
ggaaaagggcatacaggact

SEQ ID NO: 3393 - DNA, 20 bp, Artificial Sequence
  gRNA target sequence
gtgttaggaaaagggcatac

SEQ ID NO: 3394 - DNA, 20 bp, Artificial Sequence
  gRNA target sequence
tgttgtgagtgttaggaaaa

SEQ ID NO: 3395 - DNA, 20 bp, Artificial Sequence
  gRNA target sequence
ttgttgtgagtgttaggaaa

SEQ ID NO: 3396 - DNA, 20 bp, Artificial Sequence
  gRNA target sequence
ttagttttgttgtgagtgtt

SEQ ID NO: 3397 - DNA, 20 bp, Artificial Sequence
  gRNA target sequence
ggcgggcaggatagttcaga

SEQ ID NO: 3398 - DNA, 20 bp, Artificial Sequence
  gRNA target sequence
ggactaggatgatggcgggc

SEQ ID NO: 3399 - DNA, 20 bp, Artificial Sequence
  gRNA target sequence
atgaggactaggatgatggc

SEQ ID NO: 3400 - DNA, 20 bp, Artificial Sequence
  gRNA target sequence
gatgaggactaggatgatgg

SEQ ID NO: 3401 - DNA, 20 bp, Artificial Sequence
  gRNA target sequence
ggcgatgaggactaggatga

SEQ ID NO: 3402 - DNA, 20 bp, Artificial Sequence
  gRNA target sequence
atgggagggcgatgaggact

SEQ ID NO: 3403 - DNA, 20 bp, Artificial Sequence
  gRNA target sequence
gtagggatgggagggcgatg

SEQ ID NO: 3404 - DNA, 20 bp, Artificial Sequence
  gRNA target sequence
aaggatgcgtagggatggga

SEQ ID NO: 3405 - DNA, 20 bp, Artificial Sequence
  gRNA target sequence
aaaggatgcgtagggatggg

SEQ ID NO: 3406 - DNA, 20 bp, Artificial Sequence
  gRNA target sequence
tgtaaaggatgcgtagggat

SEQ ID NO: 3407 - DNA, 20 bp, Artificial Sequence
  gRNA target sequence
atgtaaaggatgcgtaggga

SEQ ID NO: 3408 - DNA, 20 bp, Artificial Sequence
  gRNA target sequence
tgttatgtaaaggatgcgta

SEQ ID NO: 3409 - DNA, 20 bp, Artificial Sequence
  gRNA target sequence
ctgttatgtaaaggatgcgt

SEQ ID NO: 3410 - DNA, 20 bp, Artificial Sequence
  gRNA target sequence
tgacctcgtctgttatgtaa

SEQ ID NO: 3411 - DNA, 20 bp, Artificial Sequence
  gRNA target sequence
attgatttgatggtaaggga

SEQ ID NO: 3412 - DNA, 20 bp, Artificial Sequence
  gRNA target sequence
aattgatttgatggtaaggg

SEQ ID NO: 3413 - DNA, 20 bp, Artificial Sequence
  gRNA target sequence
gccaattgatttgatggtaa

SEQ ID NO: 3414 - DNA, 20 bp, Artificial Sequence
  gRNA target sequence
ggccaattgatttgatggta

SEQ ID NO: 3415 - DNA, 20 bp, Artificial Sequence
  gRNA target sequence
ttggtggccaattgatttga

SEQ ID NO: 3416 - DNA, 20 bp, Artificial Sequence
  gRNA target sequence
cgtaggttcagtaccattgg

SEQ ID NO: 3417 - DNA, 20 bp, Artificial Sequence
  gRNA target sequence
actcgtaggttcagtaccat

SEQ ID NO: 3418 - DNA, 20 bp, Artificial Sequence
  gRNA target sequence
gccgtagtcggtgtactcgt

SEQ ID NO: 3419 - DNA, 20 bp, Artificial Sequence
  gRNA target sequence
gaagattagtccgccgtagt

SEQ ID NO: 3420 - DNA, 20 bp, Artificial Sequence
  gRNA target sequence
gaataatgggggaagtatgt

SEQ ID NO: 3421 - DNA, 20 bp, Artificial Sequence
  gRNA target sequence
cctggttctaggaataatgg

SEQ ID NO: 3422 - DNA, 20 bp, Artificial Sequence
  gRNA target sequence
gcctggttctaggaataatg

SEQ ID NO: 3423 - DNA, 20 bp, Artificial Sequence
  gRNA target sequence
cgcctggttctaggaataat

SEQ ID NO: 3424 - DNA, 20 bp, Artificial Sequence
  gRNA target sequence
tcgcctggttctaggaataa

SEQ ID NO: 3425 - DNA, 20 bp, Artificial Sequence
  gRNA target sequence
gtcgcaggtcgcctggttct

SEQ ID NO: 3426 - DNA, 20 bp, Artificial Sequence
  gRNA target sequence
tcaaggagtcgcaggtcgcc

SEQ ID NO: 3427 - DNA, 20 bp, Artificial Sequence
  gRNA target sequence
tgtcaacgtcaaggagtcgc

SEQ ID NO: 3428 - DNA, 20 bp, Artificial Sequence
  gRNA target sequence
ctactcgattgtcaacgtca

SEQ ID NO: 3429 - DNA, 20 bp, Artificial Sequence
  gRNA target sequence
tacgaatgggggcttcaatc

SEQ ID NO: 3430 - DNA, 20 bp, Artificial Sequence
  gRNA target sequence
atacgaatgggggcttcaat

SEQ ID NO: 3431 - DNA, 20 bp, Artificial Sequence
  gRNA target sequence
tgtaattattatacgaatgg

SEQ ID NO: 3432 - DNA, 20 bp, Artificial Sequence
  gRNA target sequence
atgtaattattatacgaatg

SEQ ID NO: 3433 - DNA, 20 bp, Artificial Sequence
  gRNA target sequence
gatgtaattattatacgaat

SEQ ID NO: 3434 - DNA, 20 bp, Artificial Sequence
  gRNA target sequence
tgatgtaattattatacgaa

SEQ ID NO: 3435 - DNA, 20 bp, Artificial Sequence
  gRNA target sequence
ctgtttttaagcctaatgtg

SEQ ID NO: 3436 - DNA, 20 bp, Artificial Sequence
  gRNA target sequence
tctgtttttaagcctaatgt

SEQ ID NO: 3437 - DNA, 20 bp, Artificial Sequence
  gRNA target sequence
atctgtttttaagcctaatg

SEQ ID NO: 3438 - DNA, 20 bp, Artificial Sequence
  gRNA target sequence
gtggtttggtttagacgtcc

SEQ ID NO: 3439 - DNA, 20 bp, Artificial Sequence
  gRNA target sequence
agtggtttggtttagacgtc

SEQ ID NO: 3440 - DNA, 20 bp, Artificial Sequence
  gRNA target sequence
gtgtagcggtgaaagtggtt

SEQ ID NO: 3441 - DNA, 20 bp, Artificial Sequence
  gRNA target sequence
cggtcgtgtagcggtgaaag

SEQ ID NO: 3442 - DNA, 20 bp, Artificial Sequence
  gRNA target sequence
gtatacccccggtcgtgtag

SEQ ID NO: 3443 - DNA, 20 bp, Artificial Sequence
  gRNA target sequence
cattgaccgtagtatacccc

SEQ ID NO: 3444 - DNA, 20 bp, Artificial Sequence
  gRNA target sequence
ggacgatgggcatgaaactg

SEQ ID NO: 3445 - DNA, 20 bp, Artificial Sequence
  gRNA target sequence
ggaattaattctaggacgat

SEQ ID NO: 3446 - DNA, 20 bp, Artificial Sequence
  gRNA target sequence
gggaattaattctaggacga

SEQ ID NO: 3447 - DNA, 20 bp, Artificial Sequence
  gRNA target sequence
tttttaggggaattaattct

SEQ ID NO: 3448 - DNA, 20 bp, Artificial Sequence
  gRNA target sequence
cctatttcaaagatttttag

SEQ ID NO: 3449 - DNA, 20 bp, Artificial Sequence
  gRNA target sequence
ccctatttcaaagattttta

SEQ ID NO: 3450 - DNA, 20 bp, Artificial Sequence
  gRNA target sequence
gccctatttcaaagattttt

SEQ ID NO: 3451 - DNA, 20 bp, Artificial Sequence
  gRNA target sequence
gggtgctatagggtaaatac

SEQ ID NO: 3452 - DNA, 20 bp, Artificial Sequence
  gRNA target sequence
ggggtgctatagggtaaata

SEQ ID NO: 3453 - DNA, 20 bp, Artificial Sequence
  gRNA target sequence
ggggtagagggggtgctata

SEQ ID NO: 3454 - DNA, 20 bp, Artificial Sequence
  gRNA target sequence
gggggtagagggggtgctat

SEQ ID NO: 3455 - DNA, 20 bp, Artificial Sequence
  gRNA target sequence
ggctctagagggggtagagg

SEQ ID NO: 3456 - DNA, 20 bp, Artificial Sequence
  gRNA target sequence
gggctctagagggggtagag

SEQ ID NO: 3457 - DNA, 20 bp, Artificial Sequence
  gRNA target sequence
tgggctctagagggggtaga

SEQ ID NO: 3458 - DNA, 20 bp, Artificial Sequence
  gRNA target sequence
gtgggctctagagggggtag

SEQ ID NO: 3459 - DNA, 20 bp, Artificial Sequence
  gRNA target sequence
tttacagtgggctctagagg

SEQ ID NO: 3460 - DNA, 20 bp, Artificial Sequence
  gRNA target sequence
ctttacagtgggctctagag

SEQ ID NO: 3461 - DNA, 20 bp, Artificial Sequence
  gRNA target sequence
gctttacagtgggctctaga

SEQ ID NO: 3462 - DNA, 20 bp, Artificial Sequence
  gRNA target sequence
agctttacagtgggctctag

SEQ ID NO: 3463 - DNA, 20 bp, Artificial Sequence
  gRNA target sequence
tgctaagttagctttacagt

SEQ ID NO: 3464 - DNA, 20 bp, Artificial Sequence
  gRNA target sequence
atgctaagttagctttacag

SEQ ID NO: 3465 - DNA, 20 bp, Artificial Sequence
  gRNA target sequence
ctcttaatctttaacttaaa

SEQ ID NO: 3466 - DNA, 20 bp, Artificial Sequence
  gRNA target sequence
atttcactgtaaagaggtgt

SEQ ID NO: 3467 - DNA, 20 bp, Artificial Sequence
  gRNA target sequence
tggggcatttcactgtaaag

SEQ ID NO: 3468 - DNA, 20 bp, Artificial Sequence
  gRNA target sequence
catacggtagtatttagttg

SEQ ID NO: 3469 - DNA, 20 bp, Artificial Sequence
  gRNA target sequence
ccatacggtagtatttagtt

SEQ ID NO: 3470 - DNA, 20 bp, Artificial Sequence
  gRNA target sequence
gccatacggtagtatttagt

SEQ ID NO: 3471 - DNA, 20 bp, Artificial Sequence
  gRNA target sequence
ggtaattatggtgggccata

SEQ ID NO: 3472 - DNA, 20 bp, Artificial Sequence
  gRNA target sequence
agtatgggggtaattatggt

SEQ ID NO: 3473 - DNA, 20 bp, Artificial Sequence
  gRNA target sequence
gagtatgggggtaattatgg

SEQ ID NO: 3474 - DNA, 20 bp, Artificial Sequence
  gRNA target sequence
aaggagtatgggggtaatta

SEQ ID NO: 3475 - DNA, 20 bp, Artificial Sequence
  gRNA target sequence
gaatagtgtaaggagtatgg

SEQ ID NO: 3476 - DNA, 20 bp, Artificial Sequence
  gRNA target sequence
ggaatagtgtaaggagtatg

SEQ ID NO: 3477 - DNA, 20 bp, Artificial Sequence
  gRNA target sequence
aggaatagtgtaaggagtat

SEQ ID NO: 3478 - DNA, 20 bp, Artificial Sequence
  gRNA target sequence
gaggaatagtgtaaggagta

SEQ ID NO: 3479 - DNA, 20 bp, Artificial Sequence
  gRNA target sequence
gggtgatgaggaatagtgta

SEQ ID NO: 3480 - DNA, 20 bp, Artificial Sequence
  gRNA target sequence
atatttttagttgggtgatg

SEQ ID NO: 3481 - DNA, 20 bp, Artificial Sequence
  gRNA target sequence
tgtgtttaatatttttagtt

SEQ ID NO: 3482 - DNA, 20 bp, Artificial Sequence
  gRNA target sequence
ttgtgtttaatatttttagt

SEQ ID NO: 3483 - DNA, 20 bp, Artificial Sequence
  gRNA target sequence
gctttggtgagggaggtagg

SEQ ID NO: 3484 - DNA, 20 bp, Artificial Sequence
  gRNA target sequence
tgggctttggtgagggaggt

SEQ ID NO: 3485 - DNA, 20 bp, Artificial Sequence
  gRNA target sequence
tttatgggctttggtgaggg

SEQ ID NO: 3486 - DNA, 20 bp, Artificial Sequence
  gRNA target sequence
atttttatgggctttggtga

SEQ ID NO: 3487 - DNA, 20 bp, Artificial Sequence
  gRNA target sequence
tatttttatgggctttggtg

SEQ ID NO: 3488 - DNA, 20 bp, Artificial Sequence
  gRNA target sequence
ttttttatttttatgggctt

SEQ ID NO: 3489 - DNA, 20 bp, Artificial Sequence
  gRNA target sequence
ttataattttttatttttat

SEQ ID NO: 3490 - DNA, 20 bp, Artificial Sequence
  gRNA target sequence
gttataattttttattttta

SEQ ID NO: 3491 - DNA, 20 bp, Artificial Sequence
  gRNA target sequence
ttcgttcattttggttctca

SEQ ID NO: 3492 - DNA, 20 bp, Artificial Sequence
  gRNA target sequence
tttcgttcattttggttctc

SEQ ID NO: 3493 - DNA, 20 bp, Artificial Sequence
  gRNA target sequence
gaacagattttcgttcattt

SEQ ID NO: 3494 - DNA, 20 bp, Artificial Sequence
  gRNA target sequence
gggtaggcctaggattgtgg

SEQ ID NO: 3495 - DNA, 20 bp, Artificial Sequence
  gRNA target sequence
cgggtaggcctaggattgtg

SEQ ID NO: 3496 - DNA, 20 bp, Artificial Sequence
  gRNA target sequence
gcgggtaggcctaggattgt

SEQ ID NO: 3497 - DNA, 20 bp, Artificial Sequence
  gRNA target sequence
ggcgggtaggcctaggattg

SEQ ID NO: 3498 - DNA, 20 bp, Artificial Sequence
  gRNA target sequence
gtactgcggcgggtaggcct

SEQ ID NO: 3499 - DNA, 20 bp, Artificial Sequence
  gRNA target sequence
tgatcagtactgcggcgggt

SEQ ID NO: 3500 - DNA, 20 bp, Artificial Sequence
  gRNA target sequence
agaatgatcagtactgcggc

SEQ ID NO: 3501 - DNA, 20 bp, Artificial Sequence
  gRNA target sequence
tagaatgatcagtactgcgg

SEQ ID NO: 3502 - DNA, 20 bp, Artificial Sequence
  gRNA target sequence
aaatagaatgatcagtactg

SEQ ID NO: 3503 - DNA, 20 bp, Artificial Sequence
  gRNA target sequence
gaggtggggatcaatagagg

SEQ ID NO: 3504 - DNA, 20 bp, Artificial Sequence
  gRNA target sequence
ggaggtggggatcaatagag

SEQ ID NO: 3505 - DNA, 20 bp, Artificial Sequence
  gRNA target sequence
tggaggtggggatcaataga

SEQ ID NO: 3506 - DNA, 20 bp, Artificial Sequence
  gRNA target sequence
ttggaggtggggatcaatag

SEQ ID NO: 3507 - DNA, 20 bp, Artificial Sequence
  gRNA target sequence
tgatgagatatttggaggtg

SEQ ID NO: 3508 - DNA, 20 bp, Artificial Sequence
  gRNA target sequence
ttgatgagatatttggaggt

SEQ ID NO: 3509 - DNA, 20 bp, Artificial Sequence
  gRNA target sequence
gttgatgagatatttggagg

SEQ ID NO: 3510 - DNA, 20 bp, Artificial Sequence
  gRNA target sequence
gttgttgatgagatatttgg

SEQ ID NO: 3511 - DNA, 20 bp, Artificial Sequence
  gRNA target sequence
tcggttgttgatgagatatt

SEQ ID NO: 3512 - DNA, 20 bp, Artificial Sequence
  gRNA target sequence
attgttgggtggtgattagt

SEQ ID NO: 3513 - DNA, 20 bp, Artificial Sequence
  gRNA target sequence
tttgattagtcattgttggg

SEQ ID NO: 3514 - DNA, 20 bp, Artificial Sequence
  gRNA target sequence
tagtttgattagtcattgtt

SEQ ID NO: 3515 - DNA, 20 bp, Artificial Sequence
  gRNA target sequence
ttagtttgattagtcattgt

SEQ ID NO: 3516 - DNA, 20 bp, Artificial Sequence
  gRNA target sequence
tatggttatcatttgttttg

SEQ ID NO: 3517 - DNA, 20 bp, Artificial Sequence
  gRNA target sequence
tcgtcctttagtgttgtgta

SEQ ID NO: 3518 - DNA, 20 bp, Artificial Sequence
  gRNA target sequence
ggatactagtataagagatc

SEQ ID NO: 3519 - DNA, 20 bp, Artificial Sequence
  gRNA target sequence
tgtggcaataaaaatgatta

SEQ ID NO: 3520 - DNA, 20 bp, Artificial Sequence
  gRNA target sequence
gagtccgaggaggttagttg

SEQ ID NO: 3521 - DNA, 20 bp, Artificial Sequence
  gRNA target sequence
agtgaggcaggagtccgagg

SEQ ID NO: 3522 - DNA, 20 bp, Artificial Sequence
  gRNA target sequence
atgagtgaggcaggagtccg

SEQ ID NO: 3523 - DNA, 20 bp, Artificial Sequence
  gRNA target sequence
ttggtgtaaatgagtgaggc

SEQ ID NO: 3524 - DNA, 20 bp, Artificial Sequence
  gRNA target sequence
gtggttggtgtaaatgagtg

SEQ ID NO: 3525 - DNA, 20 bp, Artificial Sequence
  gRNA target sequence
tttatagatagttgggtggt

SEQ ID NO: 3526 - DNA, 20 bp, Artificial Sequence
  gRNA target sequence
taggtttatagatagttggg

SEQ ID NO: 3527 - DNA, 20 bp, Artificial Sequence
  gRNA target sequence
ggctaggtttatagatagtt

SEQ ID NO: 3528 - DNA, 20 bp, Artificial Sequence
  gRNA target sequence
tggctaggtttatagatagt

SEQ ID NO: 3529 - DNA, 20 bp, Artificial Sequence
  gRNA target sequence
ataaggggatggccatggct

SEQ ID NO: 3530 - DNA, 20 bp, Artificial Sequence
  gRNA target sequence
cgctcataaggggatggcca

SEQ ID NO: 3531 - DNA, 20 bp, Artificial Sequence
  gRNA target sequence
tgtgcccgctcataagggga

SEQ ID NO: 3532 - DNA, 20 bp, Artificial Sequence
  gRNA target sequence
tcactgtgcccgctcataag

SEQ ID NO: 3533 - DNA, 20 bp, Artificial Sequence
  gRNA target sequence
atcactgtgcccgctcataa

SEQ ID NO: 3534 - DNA, 20 bp, Artificial Sequence
  gRNA target sequence
aatcactgtgcccgctcata

SEQ ID NO: 3535 - DNA, 20 bp, Artificial Sequence
  gRNA target sequence
ttgtggtaagaagtgggcta

SEQ ID NO: 3536 - DNA, 20 bp, Artificial Sequence
  gRNA target sequence
cttgtggtaagaagtgggct

SEQ ID NO: 3537 - DNA, 20 bp, Artificial Sequence
  gRNA target sequence
tgtgccttgtggtaagaagt

SEQ ID NO: 3538 - DNA, 20 bp, Artificial Sequence
  gRNA target sequence
gtgtgccttgtggtaagaag

SEQ ID NO: 3539 - DNA, 20 bp, Artificial Sequence
  gRNA target sequence
aggggtgtaggtgtgccttg

SEQ ID NO: 3540 - DNA, 20 bp, Artificial Sequence
  gRNA target sequence
agtatggggataaggggtgt

SEQ ID NO: 3541 - DNA, 20 bp, Artificial Sequence
  gRNA target sequence
ataactagtatggggataag

SEQ ID NO: 3542 - DNA, 20 bp, Artificial Sequence
  gRNA target sequence
aataactagtatggggataa

SEQ ID NO: 3543 - DNA, 20 bp, Artificial Sequence
  gRNA target sequence
taataactagtatggggata

SEQ ID NO: 3544 - DNA, 20 bp, Artificial Sequence
  gRNA target sequence
tttcgataataactagtatg

SEQ ID NO: 3545 - DNA, 20 bp, Artificial Sequence
  gRNA target sequence
gtttcgataataactagtat

SEQ ID NO: 3546 - DNA, 20 bp, Artificial Sequence
  gRNA target sequence
ggtttcgataataactagta

SEQ ID NO: 3547 - DNA, 20 bp, Artificial Sequence
  gRNA target sequence
tggttgaatgagtaggctga

SEQ ID NO: 3548 - DNA, 20 bp, Artificial Sequence
  gRNA target sequence
gggctattggttgaatgagt

SEQ ID NO: 3549 - DNA, 20 bp, Artificial Sequence
  gRNA target sequence
aggcgtacggccagggctat

SEQ ID NO: 3550 - DNA, 20 bp, Artificial Sequence
  gRNA target sequence
agcggttaggcgtacggcca

SEQ ID NO: 3551 - DNA, 20 bp, Artificial Sequence
  gRNA target sequence
tagcggttaggcgtacggcc

SEQ ID NO: 3552 - DNA, 20 bp, Artificial Sequence
  gRNA target sequence
aatgttagcggttaggcgta

SEQ ID NO: 3553 - DNA, 20 bp, Artificial Sequence
  gRNA target sequence
ctgcagtaatgttagcggtt

SEQ ID NO: 3554 - DNA, 20 bp, Artificial Sequence
  gRNA target sequence
gtggcctgcagtaatgttag

SEQ ID NO: 3555 - DNA, 20 bp, Artificial Sequence
  gRNA target sequence
caattaggtgcatgagtagg

SEQ ID NO: 3556 - DNA, 20 bp, Artificial Sequence
  gRNA target sequence
ttccaattaggtgcatgagt

SEQ ID NO: 3557 - DNA, 20 bp, Artificial Sequence
  gRNA target sequence
ctagggtggcgcttccaatt

SEQ ID NO: 3558 - DNA, 20 bp, Artificial Sequence
  gRNA target sequence
aatggttgatattgctaggg

SEQ ID NO: 3559 - DNA, 20 bp, Artificial Sequence
  gRNA target sequence
gttaatggttgatattgcta

SEQ ID NO: 3560 - DNA, 20 bp, Artificial Sequence
  gRNA target sequence
ggttaatggttgatattgct

SEQ ID NO: 3561 - DNA, 20 bp, Artificial Sequence
  gRNA target sequence
aagtgtagagggaaggttaa

SEQ ID NO: 3562 - DNA, 20 bp, Artificial Sequence
  gRNA target sequence
agatgataagtgtagaggga

SEQ ID NO: 3563 - DNA, 20 bp, Artificial Sequence
  gRNA target sequence
gtgaagatgataagtgtaga

SEQ ID NO: 3564 - DNA, 20 bp, Artificial Sequence
  gRNA target sequence
tgtgaagatgataagtgtag

SEQ ID NO: 3565 - DNA, 20 bp, Artificial Sequence
  gRNA target sequence
ttaaggcgacagcgatttct

SEQ ID NO: 3566 - DNA, 20 bp, Artificial Sequence
  gRNA target sequence
gaaaacgtaggcttggatta

SEQ ID NO: 3567 - DNA, 20 bp, Artificial Sequence
  gRNA target sequence
gaagtgtgaaaacgtaggct

SEQ ID NO: 3568 - DNA, 20 bp, Artificial Sequence
  gRNA target sequence
tactagaagtgtgaaaacgt

SEQ ID NO: 3569 - DNA, 20 bp, Artificial Sequence
  gRNA target sequence
atgtgttgtcgtgcaggtag

SEQ ID NO: 3570 - DNA, 20 bp, Artificial Sequence
  gRNA target sequence
gtcattatgtgttgtcgtgc

SEQ ID NO: 3571 - DNA, 20 bp, Artificial Sequence
  gRNA target sequence
atgataggcatgtgattggt

SEQ ID NO: 3572 - DNA, 20 bp, Artificial Sequence
  gRNA target sequence
tatgataggcatgtgattgg

SEQ ID NO: 3573 - DNA, 20 bp, Artificial Sequence
  gRNA target sequence
ctatatgataggcatgtgat

SEQ ID NO: 3574 - DNA, 20 bp, Artificial Sequence
  gRNA target sequence
gctgggttttactatatgat

SEQ ID NO: 3575 - DNA, 20 bp, Artificial Sequence
  gRNA target sequence
cctgttaggggtcatgggct

SEQ ID NO: 3576 - DNA, 20 bp, Artificial Sequence
  gRNA target sequence
ccctgttaggggtcatgggc

SEQ ID NO: 3577 - DNA, 20 bp, Artificial Sequence
  gRNA target sequence
gggcccctgttaggggtcat

SEQ ID NO: 3578 - DNA, 20 bp, Artificial Sequence
  gRNA target sequence
agggcccctgttaggggtca

SEQ ID NO: 3579 - DNA, 20 bp, Artificial Sequence
  gRNA target sequence
gctgagagggcccctgttag

SEQ ID NO: 3580 - DNA, 20 bp, Artificial Sequence
  gRNA target sequence
ggctgagagggcccctgtta

SEQ ID NO: 3581 - DNA, 20 bp, Artificial Sequence
  gRNA target sequence
gggctgagagggcccctgtt

SEQ ID NO: 3582 - DNA, 20 bp, Artificial Sequence
  gRNA target sequence
ggtcattaggagggctgaga

SEQ ID NO: 3583 - DNA, 20 bp, Artificial Sequence
  gRNA target sequence
aggtcattaggagggctgag

SEQ ID NO: 3584 - DNA, 20 bp, Artificial Sequence
  gRNA target sequence
taggccggaggtcattagga

SEQ ID NO: 3585 - DNA, 20 bp, Artificial Sequence
  gRNA target sequence
ctaggccggaggtcattagg

SEQ ID NO: 3586 - DNA, 20 bp, Artificial Sequence
  gRNA target sequence
tggctaggccggaggtcatt

SEQ ID NO: 3587 - DNA, 20 bp, Artificial Sequence
  gRNA target sequence
aaatcacatggctaggccgg

SEQ ID NO: 3588 - DNA, 20 bp, Artificial Sequence
  gRNA target sequence
gtgaaatcacatggctaggc

SEQ ID NO: 3589 - DNA, 20 bp, Artificial Sequence
  gRNA target sequence
ggaagtgaaatcacatggct

SEQ ID NO: 3590 - DNA, 20 bp, Artificial Sequence
  gRNA target sequence
ggagtggaagtgaaatcaca

SEQ ID NO: 3591 - DNA, 20 bp, Artificial Sequence
  gRNA target sequence
gtatgaggagcgttatggag

SEQ ID NO: 3592 - DNA, 20 bp, Artificial Sequence
  gRNA target sequence
gcctagtatgaggagcgtta

SEQ ID NO: 3593 - DNA, 20 bp, Artificial Sequence
  gRNA target sequence
tggttagtaggcctagtatg

SEQ ID NO: 3594 - DNA, 20 bp, Artificial Sequence
  gRNA target sequence
tggttagtgtgttggttagt

SEQ ID NO: 3595 - DNA, 20 bp, Artificial Sequence
  gRNA target sequence
ttggtatatggttagtgtgt

SEQ ID NO: 3596 - DNA, 20 bp, Artificial Sequence
  gRNA target sequence
atcgcgccatcattggtata

SEQ ID NO: 3597 - DNA, 20 bp, Artificial Sequence
  gRNA target sequence
gtgttacatcgcgccatcat

SEQ ID NO: 3598 - DNA, 20 bp, Artificial Sequence
  gRNA target sequence
caggtggtgtgtggtggcct

SEQ ID NO: 3599 - DNA, 20 bp, Artificial Sequence
  gRNA target sequence
tttggacaggtggtgtgtgg

SEQ ID NO: 3600 - DNA, 20 bp, Artificial Sequence
  gRNA target sequence
ctttttggacaggtggtgtg

SEQ ID NO: 3601 - DNA, 20 bp, Artificial Sequence
  gRNA target sequence
cgaaggcctttttggacagg

SEQ ID NO: 3602 - DNA, 20 bp, Artificial Sequence
  gRNA target sequence
tatcgaaggcctttttggac

SEQ ID NO: 3603 - DNA, 20 bp, Artificial Sequence
  gRNA target sequence
tcccgtatcgaaggcctttt

SEQ ID NO: 3604 - DNA, 20 bp, Artificial Sequence
  gRNA target sequence
ataggattatcccgtatcga

SEQ ID NO: 3605 - DNA, 20 bp, Artificial Sequence
  gRNA target sequence
aaacttctgaggtaataaat

SEQ ID NO: 3606 - DNA, 20 bp, Artificial Sequence
  gRNA target sequence
tgcgaagaaaaaaacttctg

SEQ ID NO: 3607 - DNA, 20 bp, Artificial Sequence
  gRNA target sequence
ggctaggctggagtggtaaa

SEQ ID NO: 3608 - DNA, 20 bp, Artificial Sequence
  gRNA target sequence
gggtaggggctaggctggag

SEQ ID NO: 3609 - DNA, 20 bp, Artificial Sequence
  gRNA target sequence
ttggggggtaggggctaggc

SEQ ID NO: 3610 - DNA, 20 bp, Artificial Sequence
  gRNA target sequence
ctaattggggggtaggggct

SEQ ID NO: 3611 - DNA, 20 bp, Artificial Sequence
  gRNA target sequence
ccctcctaattggggggtag

SEQ ID NO: 3612 - DNA, 20 bp, Artificial Sequence
  gRNA target sequence
gccctcctaattggggggta

SEQ ID NO: 3613 - DNA, 20 bp, Artificial Sequence
  gRNA target sequence
tgccctcctaattggggggt

SEQ ID NO: 3614 - DNA, 20 bp, Artificial Sequence
  gRNA target sequence
ccagtgccctcctaattggg

SEQ ID NO: 3615 - DNA, 20 bp, Artificial Sequence
  gRNA target sequence
gccagtgccctcctaattgg

SEQ ID NO: 3616 - DNA, 20 bp, Artificial Sequence
  gRNA target sequence
ggccagtgccctcctaattg

SEQ ID NO: 3617 - DNA, 20 bp, Artificial Sequence
  gRNA target sequence
gggccagtgccctcctaatt

SEQ ID NO: 3618 - DNA, 20 bp, Artificial Sequence
  gRNA target sequence
ggggccagtgccctcctaat

SEQ ID NO: 3619 - DNA, 20 bp, Artificial Sequence
  gRNA target sequence
agcggggtgatgcctgttgg

SEQ ID NO: 3620 - DNA, 20 bp, Artificial Sequence
  gRNA target sequence
tagcggggtgatgcctgttg

SEQ ID NO: 3621 - DNA, 20 bp, Artificial Sequence
  gRNA target sequence
ttagcggggtgatgcctgtt

SEQ ID NO: 3622 - DNA, 20 bp, Artificial Sequence
  gRNA target sequence
tttagcggggtgatgcctgt

SEQ ID NO: 3623 - DNA, 20 bp, Artificial Sequence
  gRNA target sequence
gacttctaggggatttagcg

SEQ ID NO: 3624 - DNA, 20 bp, Artificial Sequence
  gRNA target sequence
ggacttctaggggatttagc

SEQ ID NO: 3625 - DNA, 20 bp, Artificial Sequence
  gRNA target sequence
gggacttctaggggatttag

SEQ ID NO: 3626 - DNA, 20 bp, Artificial Sequence
  gRNA target sequence
tttaggagtgggacttctag

SEQ ID NO: 3627 - DNA, 20 bp, Artificial Sequence
  gRNA target sequence
gtttaggagtgggacttcta

SEQ ID NO: 3628 - DNA, 20 bp, Artificial Sequence
  gRNA target sequence
tgtttaggagtgggacttct

SEQ ID NO: 3629 - DNA, 20 bp, Artificial Sequence
  gRNA target sequence
atacggatgtgtttaggagt

SEQ ID NO: 3630 - DNA, 20 bp, Artificial Sequence
  gRNA target sequence
aatacggatgtgtttaggag

SEQ ID NO: 3631 - DNA, 20 bp, Artificial Sequence
  gRNA target sequence
cgagtaatacggatgtgttt

SEQ ID NO: 3632 - DNA, 20 bp, Artificial Sequence
  gRNA target sequence
tactcctgatgcgagtaata

SEQ ID NO: 3633 - DNA, 20 bp, Artificial Sequence
  gRNA target sequence
tattagactatggtgagctc

SEQ ID NO: 3634 - DNA, 20 bp, Artificial Sequence
  gRNA target sequence
ggttgttttctattagacta

SEQ ID NO: 3635 - DNA, 20 bp, Artificial Sequence
  gRNA target sequence
gtgcttgaattatttggttt

SEQ ID NO: 3636 - DNA, 20 bp, Artificial Sequence
  gRNA target sequence
taagcagtgcttgaattatt

SEQ ID NO: 3637 - DNA, 20 bp, Artificial Sequence
  gRNA target sequence
gtactctgaggcttgtagga

SEQ ID NO: 3638 - DNA, 20 bp, Artificial Sequence
  gRNA target sequence
agtactctgaggcttgtagg

SEQ ID NO: 3639 - DNA, 20 bp, Artificial Sequence
  gRNA target sequence
cgaagtactctgaggcttgt

SEQ ID NO: 3640 - DNA, 20 bp, Artificial Sequence
  gRNA target sequence
gggagactcgaagtactctg

SEQ ID NO: 3641 - DNA, 20 bp, Artificial Sequence
  gRNA target sequence
atgccgtcggaaatggtgaa

SEQ ID NO: 3642 - DNA, 20 bp, Artificial Sequence
  gRNA target sequence
gatgccgtcggaaatggtga

SEQ ID NO: 3643 - DNA, 20 bp, Artificial Sequence
  gRNA target sequence
gccgtagatgccgtcggaaa

SEQ ID NO: 3644 - DNA, 20 bp, Artificial Sequence
  gRNA target sequence
tgttgagccgtagatgccgt

SEQ ID NO: 3645 - DNA, 20 bp, Artificial Sequence
  gRNA target sequence
gtgaagtccgtggaagcctg

SEQ ID NO: 3646 - DNA, 20 bp, Artificial Sequence
  gRNA target sequence
caataatgacgtgaagtccg

SEQ ID NO: 3647 - DNA, 20 bp, Artificial Sequence
  gRNA target sequence
ggcggatgaagcagatagtg

SEQ ID NO: 3648 - DNA, 20 bp, Artificial Sequence
  gRNA target sequence
taaagtgaaatattagttgg

SEQ ID NO: 3649 - DNA, 20 bp, Artificial Sequence
  gRNA target sequence
atgtaaagtgaaatattagt

SEQ ID NO: 3650 - DNA, 20 bp, Artificial Sequence
  gRNA target sequence
ttcgaagccaaagtgatgtt

SEQ ID NO: 3651 - DNA, 20 bp, Artificial Sequence
  gRNA target sequence
aaaatgccagtatcaggcgg

SEQ ID NO: 3652 - DNA, 20 bp, Artificial Sequence
  gRNA target sequence
tacaaaatgccagtatcagg

SEQ ID NO: 3653 - DNA, 20 bp, Artificial Sequence
  gRNA target sequence
atctacaaaatgccagtatc

SEQ ID NO: 3654 - DNA, 20 bp, Artificial Sequence
  gRNA target sequence
gtaagaccctcatcaataga

SEQ ID NO: 3655 - DNA, 20 bp, Artificial Sequence
  gRNA target sequence
actagttaattggaagttaa

SEQ ID NO: 3656 - DNA, 20 bp, Artificial Sequence
  gRNA target sequence
tgttgtcaaaactagttaat

SEQ ID NO: 3657 - DNA, 20 bp, Artificial Sequence
  gRNA target sequence
ggtgttgattattaaaatta

SEQ ID NO: 3658 - DNA, 20 bp, Artificial Sequence
  gRNA target sequence
tattagtagtaaggctagga

SEQ ID NO: 3659 - DNA, 20 bp, Artificial Sequence
  gRNA target sequence
ttattagtagtaaggctagg

SEQ ID NO: 3660 - DNA, 20 bp, Artificial Sequence
  gRNA target sequence
taattattagtagtaaggct

SEQ ID NO: 3661 - DNA, 20 bp, Artificial Sequence
  gRNA target sequence
tgtaataattattagtagta

SEQ ID NO: 3662 - DNA, 20 bp, Artificial Sequence
  gRNA target sequence
tctatgtagccgttgagttg

SEQ ID NO: 3663 - DNA, 20 bp, Artificial Sequence
  gRNA target sequence
gaagccgcactcgtaagggg

SEQ ID NO: 3664 - DNA, 20 bp, Artificial Sequence
  gRNA target sequence
gtcgaagccgcactcgtaag

SEQ ID NO: 3665 - DNA, 20 bp, Artificial Sequence
  gRNA target sequence
ggtcgaagccgcactcgtaa

SEQ ID NO: 3666 - DNA, 20 bp, Artificial Sequence
  gRNA target sequence
gggtcgaagccgcactcgta

SEQ ID NO: 3667 - DNA, 20 bp, Artificial Sequence
  gRNA target sequence
ggacgcgggcgggggatata

SEQ ID NO: 3668 - DNA, 20 bp, Artificial Sequence
  gRNA target sequence
gggacgcgggcgggggatat

SEQ ID NO: 3669 - DNA, 20 bp, Artificial Sequence
  gRNA target sequence
ggagaaagggacgcgggcgg

SEQ ID NO: 3670 - DNA, 20 bp, Artificial Sequence
  gRNA target sequence
tggagaaagggacgcgggcg

SEQ ID NO: 3671 - DNA, 20 bp, Artificial Sequence
  gRNA target sequence
atggagaaagggacgcgggc

SEQ ID NO: 3672 - DNA, 20 bp, Artificial Sequence
  gRNA target sequence
tatggagaaagggacgcggg

SEQ ID NO: 3673 - DNA, 20 bp, Artificial Sequence
  gRNA target sequence
ttttatggagaaagggacgc

SEQ ID NO: 3674 - DNA, 20 bp, Artificial Sequence
  gRNA target sequence
attttatggagaaagggacg

SEQ ID NO: 3675 - DNA, 20 bp, Artificial Sequence
  gRNA target sequence
agaagaattttatggagaaa

SEQ ID NO: 3676 - DNA, 20 bp, Artificial Sequence
  gRNA target sequence
aagaagaattttatggagaa

SEQ ID NO: 3677 - DNA, 20 bp, Artificial Sequence
  gRNA target sequence
agctactaagaagaatttta

SEQ ID NO: 3678 - DNA, 20 bp, Artificial Sequence
  gRNA target sequence
ttctagatcaaataataaga

SEQ ID NO: 3679 - DNA, 20 bp, Artificial Sequence
  gRNA target sequence
tcatggtaggggtaaaagga

SEQ ID NO: 3680 - DNA, 20 bp, Artificial Sequence
  gRNA target sequence
ctcatggtaggggtaaaagg

SEQ ID NO: 3681 - DNA, 20 bp, Artificial Sequence
  gRNA target sequence
gggctcatggtaggggtaaa

SEQ ID NO: 3682 - DNA, 20 bp, Artificial Sequence
  gRNA target sequence
gtttgtagggctcatggtag

SEQ ID NO: 3683 - DNA, 20 bp, Artificial Sequence
  gRNA target sequence
tgtttgtagggctcatggta

SEQ ID NO: 3684 - DNA, 20 bp, Artificial Sequence
  gRNA target sequence
ttgtttgtagggctcatggt

SEQ ID NO: 3685 - DNA, 20 bp, Artificial Sequence
  gRNA target sequence
ttagttgtttgtagggctca

SEQ ID NO: 3686 - DNA, 20 bp, Artificial Sequence
  gRNA target sequence
tggcaggttagttgtttgta

SEQ ID NO: 3687 - DNA, 20 bp, Artificial Sequence
  gRNA target sequence
gtggcaggttagttgtttgt

SEQ ID NO: 3688 - DNA, 20 bp, Artificial Sequence
  gRNA target sequence
atgacataactattagtggc

SEQ ID NO: 3689 - DNA, 20 bp, Artificial Sequence
  gRNA target sequence
agggatgacataactattag

SEQ ID NO: 3690 - DNA, 20 bp, Artificial Sequence
  gRNA target sequence
taggatgatgattaataaga

SEQ ID NO: 3691 - DNA, 20 bp, Artificial Sequence
  gRNA target sequence
ctaggatgatgattaataag

SEQ ID NO: 3692 - DNA, 20 bp, Artificial Sequence
  gRNA target sequence
cataggccagacttagggct

SEQ ID NO: 3693 - DNA, 20 bp, Artificial Sequence
  gRNA target sequence
tcactcataggccagactta

SEQ ID NO: 3694 - DNA, 20 bp, Artificial Sequence
  gRNA target sequence
gtcactcataggccagactt

SEQ ID NO: 3695 - DNA, 20 bp, Artificial Sequence
  gRNA target sequence
tcctttttgtagtcactcat

SEQ ID NO: 3696 - DNA, 20 bp, Artificial Sequence
  gRNA target sequence
gtttaaactatataccaatt

SEQ ID NO: 3697 - DNA, 20 bp, Artificial Sequence
  gRNA target sequence
ttatgtaaatgaggggcatt

SEQ ID NO: 3698 - DNA, 20 bp, Artificial Sequence
  gRNA target sequence
ataatatttatgtaaatgag

SEQ ID NO: 3699 - DNA, 20 bp, Artificial Sequence
  gRNA target sequence
tataatatttatgtaaatga

SEQ ID NO: 3700 - DNA, 20 bp, Artificial Sequence
  gRNA target sequence
gtataatatttatgtaaatg

SEQ ID NO: 3701 - DNA, 20 bp, Artificial Sequence
  gRNA target sequence
tagtattcctagaagtgaga

SEQ ID NO: 3702 - DNA, 20 bp, Artificial Sequence
  gRNA target sequence
ggcatagtagggaggatatg

SEQ ID NO: 3703 - DNA, 20 bp, Artificial Sequence
  gRNA target sequence
tccttctaggcatagtaggg

SEQ ID NO: 3704 - DNA, 20 bp, Artificial Sequence
  gRNA target sequence
tattccttctaggcatagta

SEQ ID NO: 3705 - DNA, 20 bp, Artificial Sequence
  gRNA target sequence
ttattccttctaggcatagt

SEQ ID NO: 3706 - DNA, 20 bp, Artificial Sequence
  gRNA target sequence
gcgatagtattattccttct

SEQ ID NO: 3707 - DNA, 20 bp, Artificial Sequence
  gRNA target sequence
taagagggagtgggtgttga

SEQ ID NO: 3708 - DNA, 20 bp, Artificial Sequence
  gRNA target sequence
ctaagagggagtgggtgttg

SEQ ID NO: 3709 - DNA, 20 bp, Artificial Sequence
  gRNA target sequence
aatattggctaagagggagt

SEQ ID NO: 3710 - DNA, 20 bp, Artificial Sequence
  gRNA target sequence
caatattggctaagagggag

SEQ ID NO: 3711 - DNA, 20 bp, Artificial Sequence
  gRNA target sequence
aggcacaatattggctaaga

SEQ ID NO: 3712 - DNA, 20 bp, Artificial Sequence
  gRNA target sequence
taggcacaatattggctaag

SEQ ID NO: 3713 - DNA, 20 bp, Artificial Sequence
  gRNA target sequence
tatggcaataggcacaatat

SEQ ID NO: 3714 - DNA, 20 bp, Artificial Sequence
  gRNA target sequence
gcaaagactagtatggcaat

SEQ ID NO: 3715 - DNA, 20 bp, Artificial Sequence
  gRNA target sequence
gcaggcggcaaagactagta

SEQ ID NO: 3716 - DNA, 20 bp, Artificial Sequence
  gRNA target sequence
gcccaccgctgcttcgcagg

SEQ ID NO: 3717 - DNA, 20 bp, Artificial Sequence
  gRNA target sequence
taggcccaccgctgcttcgc

SEQ ID NO: 3718 - DNA, 20 bp, Artificial Sequence
  gRNA target sequence
agattgagactagtagggct

SEQ ID NO: 3719 - DNA, 20 bp, Artificial Sequence
  gRNA target sequence
gttggagattgagactagta

SEQ ID NO: 3720 - DNA, 20 bp, Artificial Sequence
  gRNA target sequence
tgttggagattgagactagt

SEQ ID NO: 3721 - DNA, 20 bp, Artificial Sequence
  gRNA target sequence
gtagtctaggccatatgtgt

SEQ ID NO: 3722 - DNA, 20 bp, Artificial Sequence
  gRNA target sequence
ttaggttatgtacgtagtct

SEQ ID NO: 3723 - DNA, 20 bp, Artificial Sequence
  gRNA target sequence
tttagcattggagtaggttt

SEQ ID NO: 3724 - DNA, 20 bp, Artificial Sequence
  gRNA target sequence
attagttttagcattggagt

SEQ ID NO: 3725 - DNA, 20 bp, Artificial Sequence
  gRNA target sequence
gggacgattagttttagcat

SEQ ID NO: 3726 - DNA, 20 bp, Artificial Sequence
  gRNA target sequence
gtggtagtaatataattgtt

SEQ ID NO: 3727 - DNA, 20 bp, Artificial Sequence
  gRNA target sequence
agtggtagtaatataattgt

SEQ ID NO: 3728 - DNA, 20 bp, Artificial Sequence
  gRNA target sequence
tttttggaaagtcatgtcag

SEQ ID NO: 3729 - DNA, 20 bp, Artificial Sequence
  gRNA target sequence
gattcaaattatgtgttttt

SEQ ID NO: 3730 - DNA, 20 bp, Artificial Sequence
  gRNA target sequence
gctaataattaggctgtggg

SEQ ID NO: 3731 - DNA, 20 bp, Artificial Sequence
  gRNA target sequence
gatgctaataattaggctgt

SEQ ID NO: 3732 - DNA, 20 bp, Artificial Sequence
  gRNA target sequence
tgatgctaataattaggctg

SEQ ID NO: 3733 - DNA, 20 bp, Artificial Sequence
  gRNA target sequence
gagggatgatgctaataatt

SEQ ID NO: 3734 - DNA, 20 bp, Artificial Sequence
  gRNA target sequence
tttggttaaaaaatagtaga

SEQ ID NO: 3735 - DNA, 20 bp, Artificial Sequence
  gRNA target sequence
atttggttaaaaaatagtag

SEQ ID NO: 3736 - DNA, 20 bp, Artificial Sequence
  gRNA target sequence
taaataggttgttgttgatt

SEQ ID NO: 3737 - DNA, 20 bp, Artificial Sequence
  gRNA target sequence
aggttggggaacagctaaat

SEQ ID NO: 3738 - DNA, 20 bp, Artificial Sequence
  gRNA target sequence
ggggtcggaggaaaaggttg

SEQ ID NO: 3739 - DNA, 20 bp, Artificial Sequence
  gRNA target sequence
gggggtcggaggaaaaggtt

SEQ ID NO: 3740 - DNA, 20 bp, Artificial Sequence
  gRNA target sequence
agggggtcggaggaaaaggt

SEQ ID NO: 3741 - DNA, 20 bp, Artificial Sequence
  gRNA target sequence
tgttagggggtcggaggaaa

SEQ ID NO: 3742 - DNA, 20 bp, Artificial Sequence
  gRNA target sequence
gggggttgttagggggtcgg

SEQ ID NO: 3743 - DNA, 20 bp, Artificial Sequence
  gRNA target sequence
gaggggggttgttagggggt

SEQ ID NO: 3744 - DNA, 20 bp, Artificial Sequence
  gRNA target sequence
ttaggaggggggttgttagg

SEQ ID NO: 3745 - DNA, 20 bp, Artificial Sequence
  gRNA target sequence
attaggaggggggttgttag

SEQ ID NO: 3746 - DNA, 20 bp, Artificial Sequence
  gRNA target sequence
tattaggaggggggttgtta

SEQ ID NO: 3747 - DNA, 20 bp, Artificial Sequence
  gRNA target sequence
gtattaggaggggggttgtt

SEQ ID NO: 3748 - DNA, 20 bp, Artificial Sequence
  gRNA target sequence
ggtagttagtattaggaggg

SEQ ID NO: 3749 - DNA, 20 bp, Artificial Sequence
  gRNA target sequence
aggtagttagtattaggagg

SEQ ID NO: 3750 - DNA, 20 bp, Artificial Sequence
  gRNA target sequence
caggtagttagtattaggag

SEQ ID NO: 3751 - DNA, 20 bp, Artificial Sequence
  gRNA target sequence
tcaggtagttagtattagga

SEQ ID NO: 3752 - DNA, 20 bp, Artificial Sequence
  gRNA target sequence
gtcaggtagttagtattagg

SEQ ID NO: 3753 - DNA, 20 bp, Artificial Sequence
  gRNA target sequence
ggagtcaggtagttagtatt

SEQ ID NO: 3754 - DNA, 20 bp, Artificial Sequence
  gRNA target sequence
gattgtgaggggtaggagtc

SEQ ID NO: 3755 - DNA, 20 bp, Artificial Sequence
  gRNA target sequence
ttgccatgattgtgaggggt

SEQ ID NO: 3756 - DNA, 20 bp, Artificial Sequence
  gRNA target sequence
tggcttgccatgattgtgag

SEQ ID NO: 3757 - DNA, 20 bp, Artificial Sequence
  gRNA target sequence
ttggcttgccatgattgtga

SEQ ID NO: 3758 - DNA, 20 bp, Artificial Sequence
  gRNA target sequence
gttggcttgccatgattgtg

SEQ ID NO: 3759 - DNA, 20 bp, Artificial Sequence
  gRNA target sequence
gttcactggataagtggcgt

SEQ ID NO: 3760 - DNA, 20 bp, Artificial Sequence
  gRNA target sequence
atagtggttcactggataag

SEQ ID NO: 3761 - DNA, 20 bp, Artificial Sequence
  gRNA target sequence
ttttcgtgatagtggttcac

SEQ ID NO: 3762 - DNA, 20 bp, Artificial Sequence
  gRNA target sequence
tagagtttttttcgtgatag

SEQ ID NO: 3763 - DNA, 20 bp, Artificial Sequence
  gRNA target sequence
gtagggagattagtatagag

SEQ ID NO: 3764 - DNA, 20 bp, Artificial Sequence
  gRNA target sequence
tataattaaggagatttgta

SEQ ID NO: 3765 - DNA, 20 bp, Artificial Sequence
  gRNA target sequence
ttataattaaggagatttgt

SEQ ID NO: 3766 - DNA, 20 bp, Artificial Sequence
  gRNA target sequence
ggctgtgaatgttataatta

SEQ ID NO: 3767 - DNA, 20 bp, Artificial Sequence
  gRNA target sequence
ataaaatatgattagttctg

SEQ ID NO: 3768 - DNA, 20 bp, Artificial Sequence
  gRNA target sequence
agccaaggtggggataagtg

SEQ ID NO: 3769 - DNA, 20 bp, Artificial Sequence
  gRNA target sequence
gggtgatgatagccaaggtg

SEQ ID NO: 3770 - DNA, 20 bp, Artificial Sequence
  gRNA target sequence
cgggtgatgatagccaaggt

SEQ ID NO: 3771 - DNA, 20 bp, Artificial Sequence
  gRNA target sequence
tcgggtgatgatagccaagg

SEQ ID NO: 3772 - DNA, 20 bp, Artificial Sequence
  gRNA target sequence
tcatcgggtgatgatagcca

SEQ ID NO: 3773 - DNA, 20 bp, Artificial Sequence
  gRNA target sequence
ttctggctggttgcctcatc

SEQ ID NO: 3774 - DNA, 20 bp, Artificial Sequence
  gRNA target sequence
gttctggctggttgcctcat

SEQ ID NO: 3775 - DNA, 20 bp, Artificial Sequence
  gRNA target sequence
ctgcgttcaggcgttctggc

SEQ ID NO: 3776 - DNA, 20 bp, Artificial Sequence
  gRNA target sequence
gtgcctgcgttcaggcgttc

SEQ ID NO: 3777 - DNA, 20 bp, Artificial Sequence
  gRNA target sequence
ggaagtatgtgcctgcgttc

SEQ ID NO: 3778 - DNA, 20 bp, Artificial Sequence
  gRNA target sequence
agcctactagggtgtagaat

SEQ ID NO: 3779 - DNA, 20 bp, Artificial Sequence
  gRNA target sequence
taggggaagggagcctacta

SEQ ID NO: 3780 - DNA, 20 bp, Artificial Sequence
  gRNA target sequence
gtaggggaagggagcctact

SEQ ID NO: 3781 - DNA, 20 bp, Artificial Sequence
  gRNA target sequence
tagtgcgatgagtaggggaa

SEQ ID NO: 3782 - DNA, 20 bp, Artificial Sequence
  gRNA target sequence
ttagtgcgatgagtagggga

SEQ ID NO: 3783 - DNA, 20 bp, Artificial Sequence
  gRNA target sequence
taaattagtgcgatgagtag

SEQ ID NO: 3784 - DNA, 20 bp, Artificial Sequence
  gRNA target sequence
gtaaattagtgcgatgagta

SEQ ID NO: 3785 - DNA, 20 bp, Artificial Sequence
  gRNA target sequence
tgtaaattagtgcgatgagt

SEQ ID NO: 3786 - DNA, 20 bp, Artificial Sequence
  gRNA target sequence
tagaatgtttagtgagccta

SEQ ID NO: 3787 - DNA, 20 bp, Artificial Sequence
  gRNA target sequence
gtagaatgtttagtgagcct

SEQ ID NO: 3788 - DNA, 20 bp, Artificial Sequence
  gRNA target sequence
tcaggagtttgatagttctt

SEQ ID NO: 3789 - DNA, 20 bp, Artificial Sequence
  gRNA target sequence
ctcaggagtttgatagttct

SEQ ID NO: 3790 - DNA, 20 bp, Artificial Sequence
  gRNA target sequence
tcatattaagttgttggctc

SEQ ID NO: 3791 - DNA, 20 bp, Artificial Sequence
  gRNA target sequence
agctagtcatattaagttgt

SEQ ID NO: 3792 - DNA, 20 bp, Artificial Sequence
  gRNA target sequence
cataagtggagtccgtaaag

SEQ ID NO: 3793 - DNA, 20 bp, Artificial Sequence
  gRNA target sequence
gggctttagggagtcataag

SEQ ID NO: 3794 - DNA, 20 bp, Artificial Sequence
  gRNA target sequence
gggcttcgacatgggcttta

SEQ ID NO: 3795 - DNA, 20 bp, Artificial Sequence
  gRNA target sequence
ggggcttcgacatgggcttt

SEQ ID NO: 3796 - DNA, 20 bp, Artificial Sequence
  gRNA target sequence
agcgatgggggcttcgacat

SEQ ID NO: 3797 - DNA, 20 bp, Artificial Sequence
  gRNA target sequence
cagcgatgggggcttcgaca

SEQ ID NO: 3798 - DNA, 20 bp, Artificial Sequence
  gRNA target sequence
tactattgacccagcgatgg

SEQ ID NO: 3799 - DNA, 20 bp, Artificial Sequence
  gRNA target sequence
gtactattgacccagcgatg

SEQ ID NO: 3800 - DNA, 20 bp, Artificial Sequence
  gRNA target sequence
agtactattgacccagcgat

SEQ ID NO: 3801 - DNA, 20 bp, Artificial Sequence
  gRNA target sequence
aagtactattgacccagcga

SEQ ID NO: 3802 - DNA, 20 bp, Artificial Sequence
  gRNA target sequence
gcctagttttaagagtactg

SEQ ID NO: 3803 - DNA, 20 bp, Artificial Sequence
  gRNA target sequence
gggggttgagaatgagtgtg

SEQ ID NO: 3804 - DNA, 20 bp, Artificial Sequence
  gRNA target sequence
aggctatgtgttttgtcagg

SEQ ID NO: 3805 - DNA, 20 bp, Artificial Sequence
  gRNA target sequence
taggctatgtgttttgtcag

SEQ ID NO: 3806 - DNA, 20 bp, Artificial Sequence
  gRNA target sequence
gtaggctatgtgttttgtca

SEQ ID NO: 3807 - DNA, 20 bp, Artificial Sequence
  gRNA target sequence
ggtaggctatgtgttttgtc

SEQ ID NO: 3808 - DNA, 20 bp, Artificial Sequence
  gRNA target sequence
ggatagtacaaggaaggggt

SEQ ID NO: 3809 - DNA, 20 bp, Artificial Sequence
  gRNA target sequence
atagggatagtacaaggaag

SEQ ID NO: 3810 - DNA, 20 bp, Artificial Sequence
  gRNA target sequence
catagggatagtacaaggaa

SEQ ID NO: 3811 - DNA, 20 bp, Artificial Sequence
  gRNA target sequence
tcatagggatagtacaagga

SEQ ID NO: 3812 - DNA, 20 bp, Artificial Sequence
  gRNA target sequence
tgcctcatagggatagtaca

SEQ ID NO: 3813 - DNA, 20 bp, Artificial Sequence
  gRNA target sequence
tgttataattatgcctcata

SEQ ID NO: 3814 - DNA, 20 bp, Artificial Sequence
  gRNA target sequence
ttgttataattatgcctcat

SEQ ID NO: 3815 - DNA, 20 bp, Artificial Sequence
  gRNA target sequence
gtctgtttgtcgtaggcaga

SEQ ID NO: 3816 - DNA, 20 bp, Artificial Sequence
  gRNA target sequence
attttaggtctgtttgtcgt

SEQ ID NO: 3817 - DNA, 20 bp, Artificial Sequence
  gRNA target sequence
agtatgcaatgagcgatttt

SEQ ID NO: 3818 - DNA, 20 bp, Artificial Sequence
  gRNA target sequence
ctgttactacgagggctatg

SEQ ID NO: 3819 - DNA, 20 bp, Artificial Sequence
  gRNA target sequence
gagaatggctgttactacga

SEQ ID NO: 3820 - DNA, 20 bp, Artificial Sequence
  gRNA target sequence
tgagaatggctgttactacg

SEQ ID NO: 3821 - DNA, 20 bp, Artificial Sequence
  gRNA target sequence
tcagggggtttggatgagaa

SEQ ID NO: 3822 - DNA, 20 bp, Artificial Sequence
  gRNA target sequence
cggtgaagcttcagggggtt

SEQ ID NO: 3823 - DNA, 20 bp, Artificial Sequence
  gRNA target sequence
tgcgccggtgaagcttcagg

SEQ ID NO: 3824 - DNA, 20 bp, Artificial Sequence
  gRNA target sequence
ctgcgccggtgaagcttcag

SEQ ID NO: 3825 - DNA, 20 bp, Artificial Sequence
  gRNA target sequence
actgcgccggtgaagcttca

SEQ ID NO: 3826 - DNA, 20 bp, Artificial Sequence
  gRNA target sequence
gactgcgccggtgaagcttc

SEQ ID NO: 3827 - DNA, 20 bp, Artificial Sequence
  gRNA target sequence
gattatgagaatgactgcgc

SEQ ID NO: 3828 - DNA, 20 bp, Artificial Sequence
  gRNA target sequence
taatgaggatgtaagcccgt

SEQ ID NO: 3829 - DNA, 20 bp, Artificial Sequence
  gRNA target sequence
gtaatgaggatgtaagcccg

SEQ ID NO: 3830 - DNA, 20 bp, Artificial Sequence
  gRNA target sequence
tgctaggcagaatagtaatg

SEQ ID NO: 3831 - DNA, 20 bp, Artificial Sequence
  gRNA target sequence
gttcgtagtttgagtttgct

SEQ ID NO: 3832 - DNA, 20 bp, Artificial Sequence
  gRNA target sequence
gagtttgaagtccttgagag

SEQ ID NO: 3833 - DNA, 20 bp, Artificial Sequence
  gRNA target sequence
gtcatcaaaaagctattagt

SEQ ID NO: 3834 - DNA, 20 bp, Artificial Sequence
  gRNA target sequence
agtcatcaaaaagctattag

SEQ ID NO: 3835 - DNA, 20 bp, Artificial Sequence
  gRNA target sequence
ggggtaaggcgaggttagcg

SEQ ID NO: 3836 - DNA, 20 bp, Artificial Sequence
  gRNA target sequence
taatagtggggggtaaggcg

SEQ ID NO: 3837 - DNA, 20 bp, Artificial Sequence
  gRNA target sequence
taggttaatagtggggggta

SEQ ID NO: 3838 - DNA, 20 bp, Artificial Sequence
  gRNA target sequence
cccagtaggttaatagtggg

SEQ ID NO: 3839 - DNA, 20 bp, Artificial Sequence
  gRNA target sequence
tcccagtaggttaatagtgg

SEQ ID NO: 3840 - DNA, 20 bp, Artificial Sequence
  gRNA target sequence
ctcccagtaggttaatagtg

SEQ ID NO: 3841 - DNA, 20 bp, Artificial Sequence
  gRNA target sequence
tctcccagtaggttaatagt

SEQ ID NO: 3842 - DNA, 20 bp, Artificial Sequence
  gRNA target sequence
ttctcccagtaggttaatag

SEQ ID NO: 3843 - DNA, 20 bp, Artificial Sequence
  gRNA target sequence
gcacagagagttctcccagt

SEQ ID NO: 3844 - DNA, 20 bp, Artificial Sequence
  gRNA target sequence
gatatttgatcaggagaacg

SEQ ID NO: 3845 - DNA, 20 bp, Artificial Sequence
  gRNA target sequence
taggagagtgatatttgatc

SEQ ID NO: 3846 - DNA, 20 bp, Artificial Sequence
  gRNA target sequence
gtatgttgagtcctgtaagt

SEQ ID NO: 3847 - DNA, 20 bp, Artificial Sequence
  gRNA target sequence
aaatatgtagagggagtata

SEQ ID NO: 3848 - DNA, 20 bp, Artificial Sequence
  gRNA target sequence
taaatatgtagagggagtat

SEQ ID NO: 3849 - DNA, 20 bp, Artificial Sequence
  gRNA target sequence
tgttgtggtaaatatgtaga

SEQ ID NO: 3850 - DNA, 20 bp, Artificial Sequence
  gRNA target sequence
gtgttgtggtaaatatgtag

SEQ ID NO: 3851 - DNA, 20 bp, Artificial Sequence
  gRNA target sequence
gagtgagccccattgtgttg

SEQ ID NO: 3852 - DNA, 20 bp, Artificial Sequence
  gRNA target sequence
ttttatgttgttaatgtggt

SEQ ID NO: 3853 - DNA, 20 bp, Artificial Sequence
  gRNA target sequence
gttttatgttgttaatgtgg

SEQ ID NO: 3854 - DNA, 20 bp, Artificial Sequence
  gRNA target sequence
agggttttatgttgttaatg

SEQ ID NO: 3855 - DNA, 20 bp, Artificial Sequence
  gRNA target sequence
gtgttttctcgtgtgaatga

SEQ ID NO: 3856 - DNA, 20 bp, Artificial Sequence
  gRNA target sequence
ggtgttttctcgtgtgaatg

SEQ ID NO: 3857 - DNA, 20 bp, Artificial Sequence
  gRNA target sequence
ggataggtgtatgaacatga

SEQ ID NO: 3858 - DNA, 20 bp, Artificial Sequence
  gRNA target sequence
gggataggtgtatgaacatg

SEQ ID NO: 3859 - DNA, 20 bp, Artificial Sequence
  gRNA target sequence
ataggaggagaatgggggat

SEQ ID NO: 3860 - DNA, 20 bp, Artificial Sequence
  gRNA target sequence
gagggataggaggagaatgg

SEQ ID NO: 3861 - DNA, 20 bp, Artificial Sequence
  gRNA target sequence
tgagggataggaggagaatg

SEQ ID NO: 3862 - DNA, 20 bp, Artificial Sequence
  gRNA target sequence
ttgagggataggaggagaat

SEQ ID NO: 3863 - DNA, 20 bp, Artificial Sequence
  gRNA target sequence
gttgagggataggaggagaa

SEQ ID NO: 3864 - DNA, 20 bp, Artificial Sequence
  gRNA target sequence
tgtcggggttgagggatagg

SEQ ID NO: 3865 - DNA, 20 bp, Artificial Sequence
  gRNA target sequence
tgatgtcggggttgagggat

SEQ ID NO: 3866 - DNA, 20 bp, Artificial Sequence
  gRNA target sequence
ggtaatgatgtcggggttga

SEQ ID NO: 3867 - DNA, 20 bp, Artificial Sequence
  gRNA target sequence
cggtaatgatgtcggggttg

SEQ ID NO: 3868 - DNA, 20 bp, Artificial Sequence
  gRNA target sequence
aaaacccggtaatgatgtcg

SEQ ID NO: 3869 - DNA, 20 bp, Artificial Sequence
  gRNA target sequence
gaaaacccggtaatgatgtc

SEQ ID NO: 3870 - DNA, 20 bp, Artificial Sequence
  gRNA target sequence
ggaaaacccggtaatgatgt

SEQ ID NO: 3871 - DNA, 20 bp, Artificial Sequence
  gRNA target sequence
atatttacaagaggaaaacc

SEQ ID NO: 3872 - DNA, 20 bp, Artificial Sequence
  gRNA target sequence
ggttaaactatatttacaag

SEQ ID NO: 3873 - DNA, 20 bp, Artificial Sequence
  gRNA target sequence
agattcacaatctgatgttt

SEQ ID NO: 3874 - DNA, 20 bp, Artificial Sequence
  gRNA target sequence
gagctttctcggtaaataag

SEQ ID NO: 3875 - DNA, 20 bp, Artificial Sequence
  gRNA target sequence
tgagctttctcggtaaataa

SEQ ID NO: 3876 - DNA, 20 bp, Artificial Sequence
  gRNA target sequence
gtgagctttctcggtaaata

SEQ ID NO: 3877 - DNA, 20 bp, Artificial Sequence
  gRNA target sequence
gcagttcttgtgagctttct

SEQ ID NO: 3878 - DNA, 20 bp, Artificial Sequence
  gRNA target sequence
agccatgttgttagacatgg

SEQ ID NO: 3879 - DNA, 20 bp, Artificial Sequence
  gRNA target sequence
aagccatgttgttagacatg

SEQ ID NO: 3880 - DNA, 20 bp, Artificial Sequence
  gRNA target sequence
aaagccatgttgttagacat

SEQ ID NO: 3881 - DNA, 20 bp, Artificial Sequence
  gRNA target sequence
gaaagccatgttgttagaca

SEQ ID NO: 3882 - DNA, 20 bp, Artificial Sequence
  gRNA target sequence
tttttggggcctaagaccaa

SEQ ID NO: 3883 - DNA, 20 bp, Artificial Sequence
  gRNA target sequence
gagttgcaccaaaatttttg

SEQ ID NO: 3884 - DNA, 20 bp, Artificial Sequence
  gRNA target sequence
ggagttgcaccaaaattttt

SEQ ID NO: 3885 - DNA, 20 bp, Artificial Sequence
  gRNA target sequence
tggagttgcaccaaaatttt

SEQ ID NO: 3886 - DNA, 20 bp, Artificial Sequence
  gRNA target sequence
gcatggttattacttttatt

SEQ ID NO: 3887 - DNA, 20 bp, Artificial Sequence
  gRNA target sequence
ggtggttatagtagtgtgca

SEQ ID NO: 3888 - DNA, 20 bp, Artificial Sequence
  gRNA target sequence
tagggaagtcagggttaggg

SEQ ID NO: 3889 - DNA, 20 bp, Artificial Sequence
  gRNA target sequence
aattagggaagtcagggtta

SEQ ID NO: 3890 - DNA, 20 bp, Artificial Sequence
  gRNA target sequence
gaattagggaagtcagggtt

SEQ ID NO: 3891 - DNA, 20 bp, Artificial Sequence
  gRNA target sequence
ggggggaattagggaagtca

SEQ ID NO: 3892 - DNA, 20 bp, Artificial Sequence
  gRNA target sequence
tggggggaattagggaagtc

SEQ ID NO: 3893 - DNA, 20 bp, Artificial Sequence
  gRNA target sequence
ggtaaggatggggggaatta

SEQ ID NO: 3894 - DNA, 20 bp, Artificial Sequence
  gRNA target sequence
tggtaaggatggggggaatt

SEQ ID NO: 3895 - DNA, 20 bp, Artificial Sequence
  gRNA target sequence
acgagggtggtaaggatggg

SEQ ID NO: 3896 - DNA, 20 bp, Artificial Sequence
  gRNA target sequence
aacgagggtggtaaggatgg

SEQ ID NO: 3897 - DNA, 20 bp, Artificial Sequence
  gRNA target sequence
taacgagggtggtaaggatg

SEQ ID NO: 3898 - DNA, 20 bp, Artificial Sequence
  gRNA target sequence
ttaacgagggtggtaaggat

SEQ ID NO: 3899 - DNA, 20 bp, Artificial Sequence
  gRNA target sequence
gttaacgagggtggtaagga

SEQ ID NO: 3900 - DNA, 20 bp, Artificial Sequence
  gRNA target sequence
tagggttaacgagggtggta

SEQ ID NO: 3901 - DNA, 20 bp, Artificial Sequence
  gRNA target sequence
tttgttagggttaacgaggg

SEQ ID NO: 3902 - DNA, 20 bp, Artificial Sequence
  gRNA target sequence
ttttttgttagggttaacga

SEQ ID NO: 3903 - DNA, 20 bp, Artificial Sequence
  gRNA target sequence
tttttttgttagggttaacg

SEQ ID NO: 3904 - DNA, 20 bp, Artificial Sequence
  gRNA target sequence
ggtatgagttttttttgtta

SEQ ID NO: 3905 - DNA, 20 bp, Artificial Sequence
  gRNA target sequence
gggtatgagttttttttgtt

SEQ ID NO: 3906 - DNA, 20 bp, Artificial Sequence
  gRNA target sequence
caatggattttacataatgg

SEQ ID NO: 3907 - DNA, 20 bp, Artificial Sequence
  gRNA target sequence
acaatggattttacataatg

SEQ ID NO: 3908 - DNA, 20 bp, Artificial Sequence
  gRNA target sequence
gacaatggattttacataat

SEQ ID NO: 3909 - DNA, 20 bp, Artificial Sequence
  gRNA target sequence
cgacaatggattttacataa

SEQ ID NO: 3910 - DNA, 20 bp, Artificial Sequence
  gRNA target sequence
aataaaggtggatgcgacaa

SEQ ID NO: 3911 - DNA, 20 bp, Artificial Sequence
  gRNA target sequence
gaagagactgataataaagg

SEQ ID NO: 3912 - DNA, 20 bp, Artificial Sequence
  gRNA target sequence
ggggaagagactgataataa

SEQ ID NO: 3913 - DNA, 20 bp, Artificial Sequence
  gRNA target sequence
ggcacatgaatattgttgtg

SEQ ID NO: 3914 - DNA, 20 bp, Artificial Sequence
  gRNA target sequence
aggcacatgaatattgttgt

SEQ ID NO: 3915 - DNA, 20 bp, Artificial Sequence
  gRNA target sequence
taggcacatgaatattgttg

SEQ ID NO: 3916 - DNA, 20 bp, Artificial Sequence
  gRNA target sequence
agataataacttcttggtct

SEQ ID NO: 3917 - DNA, 20 bp, Artificial Sequence
  gRNA target sequence
agttcgagataataacttct

SEQ ID NO: 3918 - DNA, 20 bp, Artificial Sequence
  gRNA target sequence
gagctgggttgtttgggttg

SEQ ID NO: 3919 - DNA, 20 bp, Artificial Sequence
  gRNA target sequence
tagggagagctgggttgttt

SEQ ID NO: 3920 - DNA, 20 bp, Artificial Sequence
  gRNA target sequence
ttagggagagctgggttgtt

SEQ ID NO: 3921 - DNA, 20 bp, Artificial Sequence
  gRNA target sequence
tttgaagcttagggagagct

SEQ ID NO: 3922 - DNA, 20 bp, Artificial Sequence
  gRNA target sequence
gtttgaagcttagggagagc

SEQ ID NO: 3923 - DNA, 20 bp, Artificial Sequence
  gRNA target sequence
gtagtctagtttgaagctta

SEQ ID NO: 3924 - DNA, 20 bp, Artificial Sequence
  gRNA target sequence
agtagtctagtttgaagctt

SEQ ID NO: 3925 - DNA, 20 bp, Artificial Sequence
  gRNA target sequence
tgctacagggatgaatatta

SEQ ID NO: 3926 - DNA, 20 bp, Artificial Sequence
  gRNA target sequence
atgtaacgaacaatgctaca

SEQ ID NO: 3927 - DNA, 20 bp, Artificial Sequence
  gRNA target sequence
catgtaacgaacaatgctac

SEQ ID NO: 3928 - DNA, 20 bp, Artificial Sequence
  gRNA target sequence
tcacagtgagaattctatga

SEQ ID NO: 3929 - DNA, 20 bp, Artificial Sequence
  gRNA target sequence
tgaagaactgattaatgttt

SEQ ID NO: 3930 - DNA, 20 bp, Artificial Sequence
  gRNA target sequence
ttgaagaactgattaatgtt

SEQ ID NO: 3931 - DNA, 20 bp, Artificial Sequence
  gRNA target sequence
ctaagattagtatggtaatt

SEQ ID NO: 3932 - DNA, 20 bp, Artificial Sequence
  gRNA target sequence
agcggtaactaagattagta

SEQ ID NO: 3933 - DNA, 20 bp, Artificial Sequence
  gRNA target sequence
cagttggaataggttgttag

SEQ ID NO: 3934 - DNA, 20 bp, Artificial Sequence
  gRNA target sequence
agccgatgaacagttggaat

SEQ ID NO: 3935 - DNA, 20 bp, Artificial Sequence
  gRNA target sequence
cctctcagccgatgaacagt

SEQ ID NO: 3936 - DNA, 20 bp, Artificial Sequence
  gRNA target sequence
tcatcaactgatgagcaaga

SEQ ID NO: 3937 - DNA, 20 bp, Artificial Sequence
  gRNA target sequence
tgctgtgttggcatctgctc

SEQ ID NO: 3938 - DNA, 20 bp, Artificial Sequence
  gRNA target sequence
ctgctgtgttggcatctgct

SEQ ID NO: 3939 - DNA, 20 bp, Artificial Sequence
  gRNA target sequence
tgcttgaatggctgctgtgt

SEQ ID NO: 3940 - DNA, 20 bp, Artificial Sequence
  gRNA target sequence
gttgtataggattgcttgaa

SEQ ID NO: 3941 - DNA, 20 bp, Artificial Sequence
  gRNA target sequence
tatcgccgatacggttgtat

SEQ ID NO: 3942 - DNA, 20 bp, Artificial Sequence
  gRNA target sequence
tgaaaccgatatcgccgata

SEQ ID NO: 3943 - DNA, 20 bp, Artificial Sequence
  gRNA target sequence
ggataaatcatgctaaggcg

SEQ ID NO: 3944 - DNA, 20 bp, Artificial Sequence
  gRNA target sequence
gtgtaggataaatcatgcta

SEQ ID NO: 3945 - DNA, 20 bp, Artificial Sequence
  gRNA target sequence
ggtctcatgagttggagtgt

SEQ ID NO: 3946 - DNA, 20 bp, Artificial Sequence
  gRNA target sequence
ttgttgtgggtctcatgagt

SEQ ID NO: 3947 - DNA, 20 bp, Artificial Sequence
  gRNA target sequence
ttagaagggctatttgttgt

SEQ ID NO: 3948 - DNA, 20 bp, Artificial Sequence
  gRNA target sequence
tttagaagggctatttgttg

SEQ ID NO: 3949 - DNA, 20 bp, Artificial Sequence
  gRNA target sequence
gcttggattagcgtttagaa

SEQ ID NO: 3950 - DNA, 20 bp, Artificial Sequence
  gRNA target sequence
ggcttggattagcgtttaga

SEQ ID NO: 3951 - DNA, 20 bp, Artificial Sequence
  gRNA target sequence
cctagtagtggggtgaggct

SEQ ID NO: 3952 - DNA, 20 bp, Artificial Sequence
  gRNA target sequence
ggaggcctagtagtggggtg

SEQ ID NO: 3953 - DNA, 20 bp, Artificial Sequence
  gRNA target sequence
taggaggaggcctagtagtg

SEQ ID NO: 3954 - DNA, 20 bp, Artificial Sequence
  gRNA target sequence
ctaggaggaggcctagtagt

SEQ ID NO: 3955 - DNA, 20 bp, Artificial Sequence
  gRNA target sequence
gctaggaggaggcctagtag

SEQ ID NO: 3956 - DNA, 20 bp, Artificial Sequence
  gRNA target sequence
tgcctgctgctgctaggagg

SEQ ID NO: 3957 - DNA, 20 bp, Artificial Sequence
  gRNA target sequence
atttgcctgctgctgctagg

SEQ ID NO: 3958 - DNA, 20 bp, Artificial Sequence
  gRNA target sequence
ctgatttgcctgctgctgct

SEQ ID NO: 3959 - DNA, 20 bp, Artificial Sequence
  gRNA target sequence
tcaggggtggagacctaatt

SEQ ID NO: 3960 - DNA, 20 bp, Artificial Sequence
  gRNA target sequence
gtcaggggtggagacctaat

SEQ ID NO: 3961 - DNA, 20 bp, Artificial Sequence
  gRNA target sequence
tggctgaggggagtcagggg

SEQ ID NO: 3962 - DNA, 20 bp, Artificial Sequence
  gRNA target sequence
ctatggctgaggggagtcag

SEQ ID NO: 3963 - DNA, 20 bp, Artificial Sequence
  gRNA target sequence
tctatggctgaggggagtca

SEQ ID NO: 3964 - DNA, 20 bp, Artificial Sequence
  gRNA target sequence
ttctatggctgaggggagtc

SEQ ID NO: 3965 - DNA, 20 bp, Artificial Sequence
  gRNA target sequence
tggggccttctatggctgag

SEQ ID NO: 3966 - DNA, 20 bp, Artificial Sequence
  gRNA target sequence
gtggggccttctatggctga

SEQ ID NO: 3967 - DNA, 20 bp, Artificial Sequence
  gRNA target sequence
ggtggggccttctatggctg

SEQ ID NO: 3968 - DNA, 20 bp, Artificial Sequence
  gRNA target sequence
gactggggtggggccttcta

SEQ ID NO: 3969 - DNA, 20 bp, Artificial Sequence
  gRNA target sequence
gtagggctgagactggggtg

SEQ ID NO: 3970 - DNA, 20 bp, Artificial Sequence
  gRNA target sequence
agtagggctgagactggggt

SEQ ID NO: 3971 - DNA, 20 bp, Artificial Sequence
  gRNA target sequence
gagtagggctgagactgggg

SEQ ID NO: 3972 - DNA, 20 bp, Artificial Sequence
  gRNA target sequence
gtggagtagggctgagactg

SEQ ID NO: 3973 - DNA, 20 bp, Artificial Sequence
  gRNA target sequence
agtggagtagggctgagact

SEQ ID NO: 3974 - DNA, 20 bp, Artificial Sequence
  gRNA target sequence
gagtggagtagggctgagac

SEQ ID NO: 3975 - DNA, 20 bp, Artificial Sequence
  gRNA target sequence
tatagtgcttgagtggagta

SEQ ID NO: 3976 - DNA, 20 bp, Artificial Sequence
  gRNA target sequence
ctatagtgcttgagtggagt

SEQ ID NO: 3977 - DNA, 20 bp, Artificial Sequence
  gRNA target sequence
ctacaactatagtgcttgag

SEQ ID NO: 3978 - DNA, 20 bp, Artificial Sequence
  gRNA target sequence
tttctgctagggggtggaag

SEQ ID NO: 3979 - DNA, 20 bp, Artificial Sequence
  gRNA target sequence
ggctattttctgctaggggg

SEQ ID NO: 3980 - DNA, 20 bp, Artificial Sequence
  gRNA target sequence
gtgggctattttctgctagg

SEQ ID NO: 3981 - DNA, 20 bp, Artificial Sequence
  gRNA target sequence
agtgggctattttctgctag

SEQ ID NO: 3982 - DNA, 20 bp, Artificial Sequence
  gRNA target sequence
tagtgggctattttctgcta

SEQ ID NO: 3983 - DNA, 20 bp, Artificial Sequence
  gRNA target sequence
ttagtgggctattttctgct

SEQ ID NO: 3984 - DNA, 20 bp, Artificial Sequence
  gRNA target sequence
gtgttagagtttggattagt

SEQ ID NO: 3985 - DNA, 20 bp, Artificial Sequence
  gRNA target sequence
agtgttagagtttggattag

SEQ ID NO: 3986 - DNA, 20 bp, Artificial Sequence
  gRNA target sequence
ctaagcatagtgttagagtt

SEQ ID NO: 3987 - DNA, 20 bp, Artificial Sequence
  gRNA target sequence
gcagactgctgcgaacagag

SEQ ID NO: 3988 - DNA, 20 bp, Artificial Sequence
  gRNA target sequence
tttgatgtcattttgtgtaa

SEQ ID NO: 3989 - DNA, 20 bp, Artificial Sequence
  gRNA target sequence
ttttgatgtcattttgtgta

SEQ ID NO: 3990 - DNA, 20 bp, Artificial Sequence
  gRNA target sequence
tagttgacttgaagtggaga

SEQ ID NO: 3991 - DNA, 20 bp, Artificial Sequence
  gRNA target sequence
gagtcctagttgacttgaag

SEQ ID NO: 3992 - DNA, 20 bp, Artificial Sequence
  gRNA target sequence
gcaggaatgctaggtgtggt

SEQ ID NO: 3993 - DNA, 20 bp, Artificial Sequence
  gRNA target sequence
atgtgcaggaatgctaggtg

SEQ ID NO: 3994 - DNA, 20 bp, Artificial Sequence
  gRNA target sequence
tacagatgtgcaggaatgct

SEQ ID NO: 3995 - DNA, 20 bp, Artificial Sequence
  gRNA target sequence
aggcgtgggtacagatgtgc

SEQ ID NO: 3996 - DNA, 20 bp, Artificial Sequence
  gRNA target sequence
tatggctttgaagaaggcgt

SEQ ID NO: 3997 - DNA, 20 bp, Artificial Sequence
  gRNA target sequence
gtatggctttgaagaaggcg

SEQ ID NO: 3998 - DNA, 20 bp, Artificial Sequence
  gRNA target sequence
aaatagtatggctttgaaga

SEQ ID NO: 3999 - DNA, 20 bp, Artificial Sequence
  gRNA target sequence
cccggagcacataaatagta

SEQ ID NO: 4000 - DNA, 20 bp, Artificial Sequence
  gRNA target sequence
aaggttgtggatgatggacc

SEQ ID NO: 4001 - DNA, 20 bp, Artificial Sequence
  gRNA target sequence
attgttaaggttgtggatga

SEQ ID NO: 4002 - DNA, 20 bp, Artificial Sequence
  gRNA target sequence
cttgttcattgttaaggttg

SEQ ID NO: 4003 - DNA, 20 bp, Artificial Sequence
  gRNA target sequence
gaatatcttgttcattgtta

SEQ ID NO: 4004 - DNA, 20 bp, Artificial Sequence
  gRNA target sequence
ggaggttgaagtgagaggta

SEQ ID NO: 4005 - DNA, 20 bp, Artificial Sequence
  gRNA target sequence
gtgagggaggttgaagtgag

SEQ ID NO: 4006 - DNA, 20 bp, Artificial Sequence
  gRNA target sequence
taggctgccaatggtgaggg

SEQ ID NO: 4007 - DNA, 20 bp, Artificial Sequence
  gRNA target sequence
tgctaggctgccaatggtga

SEQ ID NO: 4008 - DNA, 20 bp, Artificial Sequence
  gRNA target sequence
atgctaggctgccaatggtg

SEQ ID NO: 4009 - DNA, 20 bp, Artificial Sequence
  gRNA target sequence
tgctaatgctaggctgccaa

SEQ ID NO: 4010 - DNA, 20 bp, Artificial Sequence
  gRNA target sequence
aaggtattcctgctaatgct

SEQ ID NO: 4011 - DNA, 20 bp, Artificial Sequence
  gRNA target sequence
gagtagaaacctgtgaggaa

SEQ ID NO: 4012 - DNA, 20 bp, Artificial Sequence
  gRNA target sequence
ctttggagtagaaacctgtg

SEQ ID NO: 4013 - DNA, 20 bp, Artificial Sequence
  gRNA target sequence
ggtttcgatgatgtggtctt

SEQ ID NO: 4014 - DNA, 20 bp, Artificial Sequence
  gRNA target sequence
tgtttgcggtttcgatgatg

SEQ ID NO: 4015 - DNA, 20 bp, Artificial Sequence
  gRNA target sequence
gtttgtgtatgatatgtttg

SEQ ID NO: 4016 - DNA, 20 bp, Artificial Sequence
  gRNA target sequence
gagagtaatagatagggctc

SEQ ID NO: 4017 - DNA, 20 bp, Artificial Sequence
  gRNA target sequence
agcgatgagagtaatagata

SEQ ID NO: 4018 - DNA, 20 bp, Artificial Sequence
  gRNA target sequence
tagcgatgagagtaatagat

SEQ ID NO: 4019 - DNA, 20 bp, Artificial Sequence
  gRNA target sequence
gctataggcgcttgtcaggg

SEQ ID NO: 4020 - DNA, 20 bp, Artificial Sequence
  gRNA target sequence
agtgctataggcgcttgtca

SEQ ID NO: 4021 - DNA, 20 bp, Artificial Sequence
  gRNA target sequence
gagtgctataggcgcttgtc

SEQ ID NO: 4022 - DNA, 20 bp, Artificial Sequence
  gRNA target sequence
aagaattattcgagtgctat

SEQ ID NO: 4023 - DNA, 20 bp, Artificial Sequence
  gRNA target sequence
gaagcgaggttgacctgtta

SEQ ID NO: 4024 - DNA, 20 bp, Artificial Sequence
  gRNA target sequence
ggaagcgaggttgacctgtt

SEQ ID NO: 4025 - DNA, 20 bp, Artificial Sequence
  gRNA target sequence
ttagtaagggtggggaagcg

SEQ ID NO: 4026 - DNA, 20 bp, Artificial Sequence
  gRNA target sequence
cgttaatgttagtaagggtg

SEQ ID NO: 4027 - DNA, 20 bp, Artificial Sequence
  gRNA target sequence
tcgttaatgttagtaagggt

SEQ ID NO: 4028 - DNA, 20 bp, Artificial Sequence
  gRNA target sequence
ttcgttaatgttagtaaggg

SEQ ID NO: 4029 - DNA, 20 bp, Artificial Sequence
  gRNA target sequence
attttcgttaatgttagtaa

SEQ ID NO: 4030 - DNA, 20 bp, Artificial Sequence
  gRNA target sequence
tattttcgttaatgttagta

SEQ ID NO: 4031 - DNA, 20 bp, Artificial Sequence
  gRNA target sequence
taatggggtttagtagggtg

SEQ ID NO: 4032 - DNA, 20 bp, Artificial Sequence
  gRNA target sequence
ttaatggggtttagtagggt

SEQ ID NO: 4033 - DNA, 20 bp, Artificial Sequence
  gRNA target sequence
tttaatggggtttagtaggg

SEQ ID NO: 4034 - DNA, 20 bp, Artificial Sequence
  gRNA target sequence
gcgtttaatggggtttagta

SEQ ID NO: 4035 - DNA, 20 bp, Artificial Sequence
  gRNA target sequence
ggcgtttaatggggtttagt

SEQ ID NO: 4036 - DNA, 20 bp, Artificial Sequence
  gRNA target sequence
cggctgccaggcgtttaatg

SEQ ID NO: 4037 - DNA, 20 bp, Artificial Sequence
  gRNA target sequence
ccggctgccaggcgtttaat

SEQ ID NO: 4038 - DNA, 20 bp, Artificial Sequence
  gRNA target sequence
tccggctgccaggcgtttaa

SEQ ID NO: 4039 - DNA, 20 bp, Artificial Sequence
  gRNA target sequence
cgaataggcttccggctgcc

SEQ ID NO: 4040 - DNA, 20 bp, Artificial Sequence
  gRNA target sequence
aaatcctgcgaataggcttc

SEQ ID NO: 4041 - DNA, 20 bp, Artificial Sequence
  gRNA target sequence
taatgagaaatcctgcgaat

SEQ ID NO: 4042 - DNA, 20 bp, Artificial Sequence
  gRNA target sequence
tgtttggaagggggatgcgg

SEQ ID NO: 4043 - DNA, 20 bp, Artificial Sequence
  gRNA target sequence
ttgtttggaagggggatgcg

SEQ ID NO: 4044 - DNA, 20 bp, Artificial Sequence
  gRNA target sequence
gttgtttggaagggggatgc

SEQ ID NO: 4045 - DNA, 20 bp, Artificial Sequence
  gRNA target sequence
tgttgtttggaagggggatg

SEQ ID NO: 4046 - DNA, 20 bp, Artificial Sequence
  gRNA target sequence
ggggattgttgtttggaagg

SEQ ID NO: 4047 - DNA, 20 bp, Artificial Sequence
  gRNA target sequence
gggggattgttgtttggaag

SEQ ID NO: 4048 - DNA, 20 bp, Artificial Sequence
  gRNA target sequence
agggggattgttgtttggaa

SEQ ID NO: 4049 - DNA, 20 bp, Artificial Sequence
  gRNA target sequence
gagggggattgttgtttgga

SEQ ID NO: 4050 - DNA, 20 bp, Artificial Sequence
  gRNA target sequence
ggtagagggggattgttgtt

SEQ ID NO: 4051 - DNA, 20 bp, Artificial Sequence
  gRNA target sequence
ctgtgagttttaggtagagg

SEQ ID NO: 4052 - DNA, 20 bp, Artificial Sequence
  gRNA target sequence
gctgtgagttttaggtagag

SEQ ID NO: 4053 - DNA, 20 bp, Artificial Sequence
  gRNA target sequence
ggctgtgagttttaggtaga

SEQ ID NO: 4054 - DNA, 20 bp, Artificial Sequence
  gRNA target sequence
gggctgtgagttttaggtag

SEQ ID NO: 4055 - DNA, 20 bp, Artificial Sequence
  gRNA target sequence
cagcgagggctgtgagtttt

SEQ ID NO: 4056 - DNA, 20 bp, Artificial Sequence
  gRNA target sequence
tcctaggaaagtgacagcga

SEQ ID NO: 4057 - DNA, 20 bp, Artificial Sequence
  gRNA target sequence
gtcctaggaaagtgacagcg

SEQ ID NO: 4058 - DNA, 20 bp, Artificial Sequence
  gRNA target sequence
ctagggctgttagaagtcct

SEQ ID NO: 4059 - DNA, 20 bp, Artificial Sequence
  gRNA target sequence
ggttaggtagttgaggtcta

SEQ ID NO: 4060 - DNA, 20 bp, Artificial Sequence
  gRNA target sequence
tggttaggtagttgaggtct

SEQ ID NO: 4061 - DNA, 20 bp, Artificial Sequence
  gRNA target sequence
gtttgttggttaggtagttg

SEQ ID NO: 4062 - DNA, 20 bp, Artificial Sequence
  gRNA target sequence
ttattttaagtttgttggtt

SEQ ID NO: 4063 - DNA, 20 bp, Artificial Sequence
  gRNA target sequence
ggattttattttaagtttgt

SEQ ID NO: 4064 - DNA, 20 bp, Artificial Sequence
  gRNA target sequence
gaaataaaatgtgcatagtg

SEQ ID NO: 4065 - DNA, 20 bp, Artificial Sequence
  gRNA target sequence
agaaataaaatgtgcatagt

SEQ ID NO: 4066 - DNA, 20 bp, Artificial Sequence
  gRNA target sequence
gagaaataaaatgtgcatag

SEQ ID NO: 4067 - DNA, 20 bp, Artificial Sequence
  gRNA target sequence
agggtagaatccgagtatgt

SEQ ID NO: 4068 - DNA, 20 bp, Artificial Sequence
  gRNA target sequence
ttgtgcggtgtgtgatgcta

SEQ ID NO: 4069 - DNA, 20 bp, Artificial Sequence
  gRNA target sequence
attgtgcggtgtgtgatgct

SEQ ID NO: 4070 - DNA, 20 bp, Artificial Sequence
  gRNA target sequence
ggcctagataggggattgtg

SEQ ID NO: 4071 - DNA, 20 bp, Artificial Sequence
  gRNA target sequence
tcgtaagaaggcctagatag

SEQ ID NO: 4072 - DNA, 20 bp, Artificial Sequence
  gRNA target sequence
ctcgtaagaaggcctagata

SEQ ID NO: 4073 - DNA, 20 bp, Artificial Sequence
  gRNA target sequence
gctcgtaagaaggcctagat

SEQ ID NO: 4074 - DNA, 20 bp, Artificial Sequence
  gRNA target sequence
gcaggttttggctcgtaaga

SEQ ID NO: 4075 - DNA, 20 bp, Artificial Sequence
  gRNA target sequence
ggaggagtaggggcaggttt

SEQ ID NO: 4076 - DNA, 20 bp, Artificial Sequence
  gRNA target sequence
ggtctaggaggagtaggggc

SEQ ID NO: 4077 - DNA, 20 bp, Artificial Sequence
  gRNA target sequence
gttaggtctaggaggagtag

SEQ ID NO: 4078 - DNA, 20 bp, Artificial Sequence
  gRNA target sequence
ggttaggtctaggaggagta

SEQ ID NO: 4079 - DNA, 20 bp, Artificial Sequence
  gRNA target sequence
aggttaggtctaggaggagt

SEQ ID NO: 4080 - DNA, 20 bp, Artificial Sequence
  gRNA target sequence
ctagtcaggttaggtctagg

SEQ ID NO: 4081 - DNA, 20 bp, Artificial Sequence
  gRNA target sequence
tttctagtcaggttaggtct

SEQ ID NO: 4082 - DNA, 20 bp, Artificial Sequence
  gRNA target sequence
atagcttttctagtcaggtt

SEQ ID NO: 4083 - DNA, 20 bp, Artificial Sequence
  gRNA target sequence
aggtaatagcttttctagtc

SEQ ID NO: 4084 - DNA, 20 bp, Artificial Sequence
  gRNA target sequence
tggtgctgtgaaattgtttt

SEQ ID NO: 4085 - DNA, 20 bp, Artificial Sequence
  gRNA target sequence
tgatgatggaggtggagatt

SEQ ID NO: 4086 - DNA, 20 bp, Artificial Sequence
  gRNA target sequence
ggttgaggtgatgatggagg

SEQ ID NO: 4087 - DNA, 20 bp, Artificial Sequence
  gRNA target sequence
ttgggttgaggtgatgatgg

SEQ ID NO: 4088 - DNA, 20 bp, Artificial Sequence
  gRNA target sequence
tttttgggttgaggtgatga

SEQ ID NO: 4089 - DNA, 20 bp, Artificial Sequence
  gRNA target sequence
aattatgcctttttgggttg

SEQ ID NO: 4090 - DNA, 20 bp, Artificial Sequence
  gRNA target sequence
aagtttaattatgccttttt

SEQ ID NO: 4091 - DNA, 20 bp, Artificial Sequence
  gRNA target sequence
aaagtttaattatgcctttt

SEQ ID NO: 4092 - DNA, 20 bp, Artificial Sequence
  gRNA target sequence
tgagtgggaagaagaaagag

SEQ ID NO: 4093 - DNA, 20 bp, Artificial Sequence
  gRNA target sequence
ggagtagggttaggatgagt

SEQ ID NO: 4094 - DNA, 20 bp, Artificial Sequence
  gRNA target sequence
aggagtagggttaggatgag

SEQ ID NO: 4095 - DNA, 20 bp, Artificial Sequence
  gRNA target sequence
atgtgattaggagtagggtt

SEQ ID NO: 4096 - DNA, 20 bp, Artificial Sequence
  gRNA target sequence
aggttatgtgattaggagta

SEQ ID NO: 4097 - DNA, 20 bp, Artificial Sequence
  gRNA target sequence
taggttatgtgattaggagt

SEQ ID NO: 4098 - DNA, 20 bp, Artificial Sequence
  gRNA target sequence
ggggaataggttatgtgatt

SEQ ID NO: 4099 - DNA, 20 bp, Artificial Sequence
  gRNA target sequence
ttgagattgctcgggggaat

SEQ ID NO: 4100 - DNA, 20 bp, Artificial Sequence
  gRNA target sequence
ttgtaattgagattgctcgg

SEQ ID NO: 4101 - DNA, 20 bp, Artificial Sequence
  gRNA target sequence
attgtaattgagattgctcg

SEQ ID NO: 4102 - DNA, 20 bp, Artificial Sequence
  gRNA target sequence
tattgtaattgagattgctc

SEQ ID NO: 4103 - DNA, 20 bp, Artificial Sequence
  gRNA target sequence
atattgtaattgagattgct

SEQ ID NO: 4104 - DNA, 20 bp, Artificial Sequence
  gRNA target sequence
actggttgaacattgtttgt

SEQ ID NO: 4105 - DNA, 20 bp, Artificial Sequence
  gRNA target sequence
cgttgattagtagtagttac

SEQ ID NO: 4106 - DNA, 20 bp, Artificial Sequence
  gRNA target sequence
cgggggctttgtatgattat

SEQ ID NO: 4107 - DNA, 20 bp, Artificial Sequence
  gRNA target sequence
gcgggggctttgtatgatta

SEQ ID NO: 4108 - DNA, 20 bp, Artificial Sequence
  gRNA target sequence
ggaggatcctattggtgcgg

SEQ ID NO: 4109 - DNA, 20 bp, Artificial Sequence
  gRNA target sequence
gggaggatcctattggtgcg

SEQ ID NO: 4110 - DNA, 20 bp, Artificial Sequence
  gRNA target sequence
cgggaggatcctattggtgc

SEQ ID NO: 4111 - DNA, 20 bp, Artificial Sequence
  gRNA target sequence
tcgggaggatcctattggtg

SEQ ID NO: 4112 - DNA, 20 bp, Artificial Sequence
  gRNA target sequence
ttgattcgggaggatcctat

SEQ ID NO: 4113 - DNA, 20 bp, Artificial Sequence
  gRNA target sequence
ggggtcagggttgattcggg

SEQ ID NO: 4114 - DNA, 20 bp, Artificial Sequence
  gRNA target sequence
agaggggtcagggttgattc

SEQ ID NO: 4115 - DNA, 20 bp, Artificial Sequence
  gRNA target sequence
gagaggggtcagggttgatt

SEQ ID NO: 4116 - DNA, 20 bp, Artificial Sequence
  gRNA target sequence
tttatgaaggagaggggtca

SEQ ID NO: 4117 - DNA, 20 bp, Artificial Sequence
  gRNA target sequence
atttatgaaggagaggggtc

SEQ ID NO: 4118 - DNA, 20 bp, Artificial Sequence
  gRNA target sequence
gaataatttatgaaggagag

SEQ ID NO: 4119 - DNA, 20 bp, Artificial Sequence
  gRNA target sequence
tgaataatttatgaaggaga

SEQ ID NO: 4120 - DNA, 20 bp, Artificial Sequence
  gRNA target sequence
ctgaataatttatgaaggag

SEQ ID NO: 4121 - DNA, 20 bp, Artificial Sequence
  gRNA target sequence
ggaagctgaataatttatga

SEQ ID NO: 4122 - DNA, 20 bp, Artificial Sequence
  gRNA target sequence
gtggtaaactttaatagtgt

SEQ ID NO: 4123 - DNA, 20 bp, Artificial Sequence
  gRNA target sequence
gtatgatggggtggtggttg

SEQ ID NO: 4124 - DNA, 20 bp, Artificial Sequence
  gRNA target sequence
gaaagagtatgatggggtgg

SEQ ID NO: 4125 - DNA, 20 bp, Artificial Sequence
  gRNA target sequence
ggtgaaagagtatgatgggg

SEQ ID NO: 4126 - DNA, 20 bp, Artificial Sequence
  gRNA target sequence
gtgggtgaaagagtatgatg

SEQ ID NO: 4127 - DNA, 20 bp, Artificial Sequence
  gRNA target sequence
tgtgggtgaaagagtatgat

SEQ ID NO: 4128 - DNA, 20 bp, Artificial Sequence
  gRNA target sequence
ctgtgggtgaaagagtatga

SEQ ID NO: 4129 - DNA, 20 bp, Artificial Sequence
  gRNA target sequence
ggaggtaggattggtgctgt

SEQ ID NO: 4130 - DNA, 20 bp, Artificial Sequence
  gRNA target sequence
tggaggtaggattggtgctg

SEQ ID NO: 4131 - DNA, 20 bp, Artificial Sequence
  gRNA target sequence
gttagcgatggaggtaggat

SEQ ID NO: 4132 - DNA, 20 bp, Artificial Sequence
  gRNA target sequence
gtggggttagcgatggaggt

SEQ ID NO: 4133 - DNA, 20 bp, Artificial Sequence
  gRNA target sequence
tttagtggggttagcgatgg

SEQ ID NO: 4134 - DNA, 20 bp, Artificial Sequence
  gRNA target sequence
tgttttagtggggttagcga

SEQ ID NO: 4135 - DNA, 20 bp, Artificial Sequence
  gRNA target sequence
tcttggtgagtgttttagtg

SEQ ID NO: 4136 - DNA, 20 bp, Artificial Sequence
  gRNA target sequence
gtcttggtgagtgttttagt

SEQ ID NO: 4137 - DNA, 20 bp, Artificial Sequence
  gRNA target sequence
ggtcttggtgagtgttttag

SEQ ID NO: 4138 - DNA, 20 bp, Artificial Sequence
  gRNA target sequence
ggggtcaggggttgaggtct

SEQ ID NO: 4139 - DNA, 20 bp, Artificial Sequence
  gRNA target sequence
ggcatgggggtcaggggttg

SEQ ID NO: 4140 - DNA, 20 bp, Artificial Sequence
  gRNA target sequence
tcctgaggcatgggggtcag

SEQ ID NO: 4141 - DNA, 20 bp, Artificial Sequence
  gRNA target sequence
atcctgaggcatgggggtca

SEQ ID NO: 4142 - DNA, 20 bp, Artificial Sequence
  gRNA target sequence
tatcctgaggcatgggggtc

SEQ ID NO: 4143 - DNA, 20 bp, Artificial Sequence
  gRNA target sequence
aggagtatcctgaggcatgg

SEQ ID NO: 4144 - DNA, 20 bp, Artificial Sequence
  gRNA target sequence
gaggagtatcctgaggcatg

SEQ ID NO: 4145 - DNA, 20 bp, Artificial Sequence
  gRNA target sequence
tgaggagtatcctgaggcat

SEQ ID NO: 4146 - DNA, 20 bp, Artificial Sequence
  gRNA target sequence
ttgaggagtatcctgaggca

SEQ ID NO: 4147 - DNA, 20 bp, Artificial Sequence
  gRNA target sequence
ggctattgaggagtatcctg

SEQ ID NO: 4148 - DNA, 20 bp, Artificial Sequence
  gRNA target sequence
tactacagcgatggctattg

SEQ ID NO: 4149 - DNA, 20 bp, Artificial Sequence
  gRNA target sequence
ctttggatatactacagcga

SEQ ID NO: 4150 - DNA, 20 bp, Artificial Sequence
  gRNA target sequence
gggggaatgatggttgtctt

SEQ ID NO: 4151 - DNA, 20 bp, Artificial Sequence
  gRNA target sequence
aatttatttagggggaatga

SEQ ID NO: 4152 - DNA, 20 bp, Artificial Sequence
  gRNA target sequence
gtttttttaatttatttagg

SEQ ID NO: 4153 - DNA, 20 bp, Artificial Sequence
  gRNA target sequence
agtttttttaatttatttag

SEQ ID NO: 4154 - DNA, 20 bp, Artificial Sequence
  gRNA target sequence
tagtttttttaatttattta

SEQ ID NO: 4155 - DNA, 20 bp, Artificial Sequence
  gRNA target sequence
atagtttttttaatttattt

SEQ ID NO: 4156 - DNA, 20 bp, Artificial Sequence
  gRNA target sequence
aattttgggggaggttatat

SEQ ID NO: 4157 - DNA, 20 bp, Artificial Sequence
  gRNA target sequence
gaattttgggggaggttata

SEQ ID NO: 4158 - DNA, 20 bp, Artificial Sequence
  gRNA target sequence
attattctgaattttggggg

SEQ ID NO: 4159 - DNA, 20 bp, Artificial Sequence
  gRNA target sequence
gttattattctgaattttgg

SEQ ID NO: 4160 - DNA, 20 bp, Artificial Sequence
  gRNA target sequence
tgttattattctgaattttg

SEQ ID NO: 4161 - DNA, 20 bp, Artificial Sequence
  gRNA target sequence
gtgttattattctgaatttt

SEQ ID NO: 4162 - DNA, 20 bp, Artificial Sequence
  gRNA target sequence
tgtgttattattctgaattt

SEQ ID NO: 4163 - DNA, 20 bp, Artificial Sequence
  gRNA target sequence
tgattgttagcggtgtggtc

SEQ ID NO: 4164 - DNA, 20 bp, Artificial Sequence
  gRNA target sequence
ttgattgttagcggtgtggt

SEQ ID NO: 4165 - DNA, 20 bp, Artificial Sequence
  gRNA target sequence
agtattgattgttagcggtg

SEQ ID NO: 4166 - DNA, 20 bp, Artificial Sequence
  gRNA target sequence
ggtttagtattgattgttag

SEQ ID NO: 4167 - DNA, 20 bp, Artificial Sequence
  gRNA target sequence
aagccttctcctatttatgg

SEQ ID NO: 4168 - DNA, 20 bp, Artificial Sequence
  gRNA target sequence
taagccttctcctatttatg

SEQ ID NO: 4169 - DNA, 20 bp, Artificial Sequence
  gRNA target sequence
ctaagccttctcctatttat

SEQ ID NO: 4170 - DNA, 20 bp, Artificial Sequence
  gRNA target sequence
tctaagccttctcctattta

SEQ ID NO: 4171 - DNA, 20 bp, Artificial Sequence
  gRNA target sequence
gtttagtaatggggtttgtg

SEQ ID NO: 4172 - DNA, 20 bp, Artificial Sequence
  gRNA target sequence
ggtttagtaatggggtttgt

SEQ ID NO: 4173 - DNA, 20 bp, Artificial Sequence
  gRNA target sequence
gggtttagtaatggggtttg

SEQ ID NO: 4174 - DNA, 20 bp, Artificial Sequence
  gRNA target sequence
tgagtgtgggtttagtaatg

SEQ ID NO: 4175 - DNA, 20 bp, Artificial Sequence
  gRNA target sequence
ttgagtgtgggtttagtaat

SEQ ID NO: 4176 - DNA, 20 bp, Artificial Sequence
  gRNA target sequence
gttgagtgtgggtttagtaa

SEQ ID NO: 4177 - DNA, 20 bp, Artificial Sequence
  gRNA target sequence
gctttgtttctgttgagtgt

SEQ ID NO: 4178 - DNA, 20 bp, Artificial Sequence
  gRNA target sequence
tgctttgtttctgttgagtg

SEQ ID NO: 4179 - DNA, 20 bp, Artificial Sequence
  gRNA target sequence
gtttttcatatcattggtcg

SEQ ID NO: 4180 - DNA, 20 bp, Artificial Sequence
  gRNA target sequence
acgatggtttttcatatcat

SEQ ID NO: 4181 - DNA, 20 bp, Artificial Sequence
  gRNA target sequence
ttgtagttgaaatacaacga

SEQ ID NO: 4182 - DNA, 20 bp, Artificial Sequence
  gRNA target sequence
gttttgcgtattggggtcat

SEQ ID NO: 4183 - DNA, 20 bp, Artificial Sequence
  gRNA target sequence
ggggttagttttgcgtattg

SEQ ID NO: 4184 - DNA, 20 bp, Artificial Sequence
  gRNA target sequence
gggggttagttttgcgtatt

SEQ ID NO: 4185 - DNA, 20 bp, Artificial Sequence
  gRNA target sequence
agggggttagttttgcgtat

SEQ ID NO: 4186 - DNA, 20 bp, Artificial Sequence
  gRNA target sequence
ggttaattaattttattagg

SEQ ID NO: 4187 - DNA, 20 bp, Artificial Sequence
  gRNA target sequence
tggttaattaattttattag

SEQ ID NO: 4188 - DNA, 20 bp, Artificial Sequence
  gRNA target sequence
gtggttaattaattttatta

SEQ ID NO: 4189 - DNA, 20 bp, Artificial Sequence
  gRNA target sequence
agtggttaattaattttatt

SEQ ID NO: 4190 - DNA, 20 bp, Artificial Sequence
  gRNA target sequence
tggggaggtcgatgaatgag

SEQ ID NO: 4191 - DNA, 20 bp, Artificial Sequence
  gRNA target sequence
agatgttggatggggtgggg

SEQ ID NO: 4192 - DNA, 20 bp, Artificial Sequence
  gRNA target sequence
cggagatgttggatggggtg

SEQ ID NO: 4193 - DNA, 20 bp, Artificial Sequence
  gRNA target sequence
gcggagatgttggatggggt

SEQ ID NO: 4194 - DNA, 20 bp, Artificial Sequence
  gRNA target sequence
tgcggagatgttggatgggg

SEQ ID NO: 4195 - DNA, 20 bp, Artificial Sequence
  gRNA target sequence
tcatgcggagatgttggatg

SEQ ID NO: 4196 - DNA, 20 bp, Artificial Sequence
  gRNA target sequence
atcatgcggagatgttggat

SEQ ID NO: 4197 - DNA, 20 bp, Artificial Sequence
  gRNA target sequence
catcatgcggagatgttgga

SEQ ID NO: 4198 - DNA, 20 bp, Artificial Sequence
  gRNA target sequence
gtttcatcatgcggagatgt

SEQ ID NO: 4199 - DNA, 20 bp, Artificial Sequence
  gRNA target sequence
tgagccgaagtttcatcatg

SEQ ID NO: 4200 - DNA, 20 bp, Artificial Sequence
  gRNA target sequence
ggaggatcaggcaggcgcca

SEQ ID NO: 4201 - DNA, 20 bp, Artificial Sequence
  gRNA target sequence
ggtgatttggaggatcaggc

SEQ ID NO: 4202 - DNA, 20 bp, Artificial Sequence
  gRNA target sequence
ctgtggtgatttggaggatc

SEQ ID NO: 4203 - DNA, 20 bp, Artificial Sequence
  gRNA target sequence
atagtcctgtggtgatttgg

SEQ ID NO: 4204 - DNA, 20 bp, Artificial Sequence
  gRNA target sequence
ggaatagtcctgtggtgatt

SEQ ID NO: 4205 - DNA, 20 bp, Artificial Sequence
  gRNA target sequence
catggctaggaatagtcctg

SEQ ID NO: 4206 - DNA, 20 bp, Artificial Sequence
  gRNA target sequence
ctggtgagtagtgcatggct

SEQ ID NO: 4207 - DNA, 20 bp, Artificial Sequence
  gRNA target sequence
ggcgtctggtgagtagtgca

SEQ ID NO: 4208 - DNA, 20 bp, Artificial Sequence
  gRNA target sequence
gaaaaggcggttgaggcgtc

SEQ ID NO: 4209 - DNA, 20 bp, Artificial Sequence
  gRNA target sequence
gattgatgaaaaggcggttg

SEQ ID NO: 4210 - DNA, 20 bp, Artificial Sequence
  gRNA target sequence
gtgggcgattgatgaaaagg

SEQ ID NO: 4211 - DNA, 20 bp, Artificial Sequence
  gRNA target sequence
gatgtgggcgattgatgaaa

SEQ ID NO: 4212 - DNA, 20 bp, Artificial Sequence
  gRNA target sequence
atttacgtctcgagtgatgt

SEQ ID NO: 4213 - DNA, 20 bp, Artificial Sequence
  gRNA target sequence
aatttacgtctcgagtgatg

SEQ ID NO: 4214 - DNA, 20 bp, Artificial Sequence
  gRNA target sequence
cgccattggcgtgaaggtag

SEQ ID NO: 4215 - DNA, 20 bp, Artificial Sequence
  gRNA target sequence
ttgaggcgccattggcgtga

SEQ ID NO: 4216 - DNA, 20 bp, Artificial Sequence
  gRNA target sequence
aaagaatattgaggcgccat

SEQ ID NO: 4217 - DNA, 20 bp, Artificial Sequence
  gRNA target sequence
gaggcagataaagaatattg

SEQ ID NO: 4218 - DNA, 20 bp, Artificial Sequence
  gRNA target sequence
ctcgcccgatgtgtaggaag

SEQ ID NO: 4219 - DNA, 20 bp, Artificial Sequence
  gRNA target sequence
ataggcctcgcccgatgtgt

SEQ ID NO: 4220 - DNA, 20 bp, Artificial Sequence
  gRNA target sequence
agagaaatgatccgtaatat

SEQ ID NO: 4221 - DNA, 20 bp, Artificial Sequence
  gRNA target sequence
gaggataatgccgatgtttc

SEQ ID NO: 4222 - DNA, 20 bp, Artificial Sequence
  gRNA target sequence
ttgctatagttgcaagcagg

SEQ ID NO: 4223 - DNA, 20 bp, Artificial Sequence
  gRNA target sequence
ctgttgctatagttgcaagc

SEQ ID NO: 4224 - DNA, 20 bp, Artificial Sequence
  gRNA target sequence
cgggaggacatagcctatga

SEQ ID NO: 4225 - DNA, 20 bp, Artificial Sequence
  gRNA target sequence
atgatatttggcctcacggg

SEQ ID NO: 4226 - DNA, 20 bp, Artificial Sequence
  gRNA target sequence
agaatgatatttggcctcac

SEQ ID NO: 4227 - DNA, 20 bp, Artificial Sequence
  gRNA target sequence
cagaatgatatttggcctca

SEQ ID NO: 4228 - DNA, 20 bp, Artificial Sequence
  gRNA target sequence
tggcccctcagaatgatatt

SEQ ID NO: 4229 - DNA, 20 bp, Artificial Sequence
  gRNA target sequence
tagtaagtttgtaattactg

SEQ ID NO: 4230 - DNA, 20 bp, Artificial Sequence
  gRNA target sequence
tgtcccaatgtatgggatgg

SEQ ID NO: 4231 - DNA, 20 bp, Artificial Sequence
  gRNA target sequence
gtctgtcccaatgtatggga

SEQ ID NO: 4232 - DNA, 20 bp, Artificial Sequence
  gRNA target sequence
ctaggtctgtcccaatgtat

SEQ ID NO: 4233 - DNA, 20 bp, Artificial Sequence
  gRNA target sequence
actaggtctgtcccaatgta

SEQ ID NO: 4234 - DNA, 20 bp, Artificial Sequence
  gRNA target sequence
ctcctcagattcattgaact

SEQ ID NO: 4235 - DNA, 20 bp, Artificial Sequence
  gRNA target sequence
gtaaagaatcgtgtgagggt

SEQ ID NO: 4236 - DNA, 20 bp, Artificial Sequence
  gRNA target sequence
ggtaaagaatcgtgtgaggg

SEQ ID NO: 4237 - DNA, 20 bp, Artificial Sequence
  gRNA target sequence
aaaggtaaagaatcgtgtga

SEQ ID NO: 4238 - DNA, 20 bp, Artificial Sequence
  gRNA target sequence
gaaaggtaaagaatcgtgtg

SEQ ID NO: 4239 - DNA, 20 bp, Artificial Sequence
  gRNA target sequence
gaagggcaagatgaagtgaa

SEQ ID NO: 4240 - DNA, 20 bp, Artificial Sequence
  gRNA target sequence
gctagggctgcaataatgaa

SEQ ID NO: 4241 - DNA, 20 bp, Artificial Sequence
  gRNA target sequence
tgctagggctgcaataatga

SEQ ID NO: 4242 - DNA, 20 bp, Artificial Sequence
  gRNA target sequence
taggaggtggagtgttgcta

SEQ ID NO: 4243 - DNA, 20 bp, Artificial Sequence
  gRNA target sequence
ataggaggtggagtgttgct

SEQ ID NO: 4244 - DNA, 20 bp, Artificial Sequence
  gRNA target sequence
tttcgtgcaagaataggagg

SEQ ID NO: 4245 - DNA, 20 bp, Artificial Sequence
  gRNA target sequence
ccgtttcgtgcaagaatagg

SEQ ID NO: 4246 - DNA, 20 bp, Artificial Sequence
  gRNA target sequence
atcccgtttcgtgcaagaat

SEQ ID NO: 4247 - DNA, 20 bp, Artificial Sequence
  gRNA target sequence
aatgggaggtgattcctagg

SEQ ID NO: 4248 - DNA, 20 bp, Artificial Sequence
  gRNA target sequence
gaatgggaggtgattcctag

SEQ ID NO: 4249 - DNA, 20 bp, Artificial Sequence
  gRNA target sequence
ggaatgggaggtgattccta

SEQ ID NO: 4250 - DNA, 20 bp, Artificial Sequence
  gRNA target sequence
cggaatgggaggtgattcct

SEQ ID NO: 4251 - DNA, 20 bp, Artificial Sequence
  gRNA target sequence
ggtgattttatcggaatggg

SEQ ID NO: 4252 - DNA, 20 bp, Artificial Sequence
  gRNA target sequence
gaaggtgattttatcggaat

SEQ ID NO: 4253 - DNA, 20 bp, Artificial Sequence
  gRNA target sequence
ggaaggtgattttatcggaa

SEQ ID NO: 4254 - DNA, 20 bp, Artificial Sequence
  gRNA target sequence
agggtggaaggtgattttat

SEQ ID NO: 4255 - DNA, 20 bp, Artificial Sequence
  gRNA target sequence
gattgtgtagtaagggtgga

SEQ ID NO: 4256 - DNA, 20 bp, Artificial Sequence
  gRNA target sequence
ctttgattgtgtagtaaggg

SEQ ID NO: 4257 - DNA, 20 bp, Artificial Sequence
  gRNA target sequence
cgtctttgattgtgtagtaa

SEQ ID NO: 4258 - DNA, 20 bp, Artificial Sequence
  gRNA target sequence
gcgtctttgattgtgtagta

SEQ ID NO: 4259 - DNA, 20 bp, Artificial Sequence
  gRNA target sequence
aaggaagagaagtaagccga

SEQ ID NO: 4260 - DNA, 20 bp, Artificial Sequence
  gRNA target sequence
gaaggaagagaagtaagccg

SEQ ID NO: 4261 - DNA, 20 bp, Artificial Sequence
  gRNA target sequence
ttaatgtcattaaggagaga

SEQ ID NO: 4262 - DNA, 20 bp, Artificial Sequence
  gRNA target sequence
gaatagtgttaatgtcatta

SEQ ID NO: 4263 - DNA, 20 bp, Artificial Sequence
  gRNA target sequence
tctgggtcgcctaggaggtc

SEQ ID NO: 4264 - DNA, 20 bp, Artificial Sequence
  gRNA target sequence
aattgtctgggtcgcctagg

SEQ ID NO: 4265 - DNA, 20 bp, Artificial Sequence
  gRNA target sequence
tataattgtctgggtcgcct

SEQ ID NO: 4266 - DNA, 20 bp, Artificial Sequence
  gRNA target sequence
tggctagggtataattgtct

SEQ ID NO: 4267 - DNA, 20 bp, Artificial Sequence
  gRNA target sequence
ttggctagggtataattgtc

SEQ ID NO: 4268 - DNA, 20 bp, Artificial Sequence
  gRNA target sequence
ggtgtttaaggggttggcta

SEQ ID NO: 4269 - DNA, 20 bp, Artificial Sequence
  gRNA target sequence
gggtgtttaaggggttggct

SEQ ID NO: 4270 - DNA, 20 bp, Artificial Sequence
  gRNA target sequence
gggaggggtgtttaaggggt

SEQ ID NO: 4271 - DNA, 20 bp, Artificial Sequence
  gRNA target sequence
tgtggggaggggtgtttaag

SEQ ID NO: 4272 - DNA, 20 bp, Artificial Sequence
  gRNA target sequence
atgtggggaggggtgtttaa

SEQ ID NO: 4273 - DNA, 20 bp, Artificial Sequence
  gRNA target sequence
gatgtggggaggggtgttta

SEQ ID NO: 4274 - DNA, 20 bp, Artificial Sequence
  gRNA target sequence
ttcgggcttgatgtggggag

SEQ ID NO: 4275 - DNA, 20 bp, Artificial Sequence
  gRNA target sequence
attcgggcttgatgtgggga

SEQ ID NO: 4276 - DNA, 20 bp, Artificial Sequence
  gRNA target sequence
cattcgggcttgatgtgggg

SEQ ID NO: 4277 - DNA, 20 bp, Artificial Sequence
  gRNA target sequence
tatcattcgggcttgatgtg

SEQ ID NO: 4278 - DNA, 20 bp, Artificial Sequence
  gRNA target sequence
atatcattcgggcttgatgt

SEQ ID NO: 4279 - DNA, 20 bp, Artificial Sequence
  gRNA target sequence
aatatcattcgggcttgatg

SEQ ID NO: 4280 - DNA, 20 bp, Artificial Sequence
  gRNA target sequence
gcgaataggaaatatcattc

SEQ ID NO: 4281 - DNA, 20 bp, Artificial Sequence
  gRNA target sequence
ggcgaataggaaatatcatt

SEQ ID NO: 4282 - DNA, 20 bp, Artificial Sequence
  gRNA target sequence
ggagaattgtgtaggcgaat

SEQ ID NO: 4283 - DNA, 20 bp, Artificial Sequence
  gRNA target sequence
gacggatcggagaattgtgt

SEQ ID NO: 4284 - DNA, 20 bp, Artificial Sequence
  gRNA target sequence
ctagtttgttagggacggat

SEQ ID NO: 4285 - DNA, 20 bp, Artificial Sequence
  gRNA target sequence
gcctcctagtttgttaggga

SEQ ID NO: 4286 - DNA, 20 bp, Artificial Sequence
  gRNA target sequence
ggacgcctcctagtttgtta

SEQ ID NO: 4287 - DNA, 20 bp, Artificial Sequence
  gRNA target sequence
aggacgcctcctagtttgtt

SEQ ID NO: 4288 - DNA, 20 bp, Artificial Sequence
  gRNA target sequence
ggatggatagtaatagggca

SEQ ID NO: 4289 - DNA, 20 bp, Artificial Sequence
  gRNA target sequence
gatgaggatggatagtaata

SEQ ID NO: 4290 - DNA, 20 bp, Artificial Sequence
  gRNA target sequence
ggatgaggatggatagtaat

SEQ ID NO: 4291 - DNA, 20 bp, Artificial Sequence
  gRNA target sequence
gattattgctaggatgagga

SEQ ID NO: 4292 - DNA, 20 bp, Artificial Sequence
  gRNA target sequence
tggggattattgctaggatg

SEQ ID NO: 4293 - DNA, 20 bp, Artificial Sequence
  gRNA target sequence
ggaggatggggattattgct

SEQ ID NO: 4294 - DNA, 20 bp, Artificial Sequence
  gRNA target sequence
gtttggatatatggaggatg

SEQ ID NO: 4295 - DNA, 20 bp, Artificial Sequence
  gRNA target sequence
tgtttggatatatggaggat

SEQ ID NO: 4296 - DNA, 20 bp, Artificial Sequence
  gRNA target sequence
ttgtttggatatatggagga

SEQ ID NO: 4297 - DNA, 20 bp, Artificial Sequence
  gRNA target sequence
tttgttgtttggatatatgg

SEQ ID NO: 4298 - DNA, 20 bp, Artificial Sequence
  gRNA target sequence
tgctttgttgtttggatata

SEQ ID NO: 4299 - DNA, 20 bp, Artificial Sequence
  gRNA target sequence
aaatattatgctttgttgtt

SEQ ID NO: 4300 - DNA, 20 bp, Artificial Sequence
  gRNA target sequence
aataaagtgattggcttagt

SEQ ID NO: 4301 - DNA, 20 bp, Artificial Sequence
  gRNA target sequence
caataaagtgattggcttag

SEQ ID NO: 4302 - DNA, 20 bp, Artificial Sequence
  gRNA target sequence
ctaggagtcaataaagtgat

SEQ ID NO: 4303 - DNA, 20 bp, Artificial Sequence
  gRNA target sequence
gaatgaggaggtctgcggct

SEQ ID NO: 4304 - DNA, 20 bp, Artificial Sequence
  gRNA target sequence
ggttagaatgaggaggtctg

SEQ ID NO: 4305 - DNA, 20 bp, Artificial Sequence
  gRNA target sequence
cgattcaggttagaatgagg

SEQ ID NO: 4306 - DNA, 20 bp, Artificial Sequence
  gRNA target sequence
ctccgattcaggttagaatg

SEQ ID NO: 4307 - DNA, 20 bp, Artificial Sequence
  gRNA target sequence
tactggttgtcctccgattc

SEQ ID NO: 4308 - DNA, 20 bp, Artificial Sequence
  gRNA target sequence
atggtaaaagggtagcttac

SEQ ID NO: 4309 - DNA, 20 bp, Artificial Sequence
  gRNA target sequence
cttgtccaatgatggtaaaa

SEQ ID NO: 4310 - DNA, 20 bp, Artificial Sequence
  gRNA target sequence
acttgtccaatgatggtaaa

SEQ ID NO: 4311 - DNA, 20 bp, Artificial Sequence
  gRNA target sequence
ggatgctacttgtccaatga

SEQ ID NO: 4312 - DNA, 20 bp, Artificial Sequence
  gRNA target sequence
gattgttgtgaagtatagta

SEQ ID NO: 4313 - DNA, 20 bp, Artificial Sequence
  gRNA target sequence
agatagttggtattaggatt

SEQ ID NO: 4314 - DNA, 20 bp, Artificial Sequence
  gRNA target sequence
ttagggagatagttggtatt

SEQ ID NO: 4315 - DNA, 20 bp, Artificial Sequence
  gRNA target sequence
ttttcaattagggagatagt

SEQ ID NO: 4316 - DNA, 20 bp, Artificial Sequence
  gRNA target sequence
gagtattttgttttcaatta

SEQ ID NO: 4317 - DNA, 20 bp, Artificial Sequence
  gRNA target sequence
tgagtattttgttttcaatt

SEQ ID NO: 4318 - DNA, 20 bp, Artificial Sequence
  gRNA target sequence
ttagtttatactacaaggac

SEQ ID NO: 4319 - DNA, 20 bp, Artificial Sequence
  gRNA target sequence
gtgtattagtttatactaca

SEQ ID NO: 4320 - DNA, 20 bp, Artificial Sequence
  gRNA target sequence
tcatctccggtttacaagac

SEQ ID NO: 4321 - DNA, 20 bp, Artificial Sequence
  gRNA target sequence
tggaaaaaggttttcatctc

SEQ ID NO: 4322 - DNA, 20 bp, Artificial Sequence
  gRNA target sequence
tctgatttgtccttggaaaa

SEQ ID NO: 4323 - DNA, 20 bp, Artificial Sequence
  gRNA target sequence
ctttttctctgatttgtcct

SEQ ID NO: 4324 - DNA, 20 bp, Artificial Sequence
  gRNA target sequence
ttagctttgggtgctaatgg

SEQ ID NO: 4325 - DNA, 20 bp, Artificial Sequence
  gRNA target sequence
atcttagctttgggtgctaa

SEQ ID NO: 4326 - DNA, 20 bp, Artificial Sequence
  gRNA target sequence
taaattagaatcttagcttt

SEQ ID NO: 4327 - DNA, 20 bp, Artificial Sequence
  gRNA target sequence
ttaaattagaatcttagctt

SEQ ID NO: 4328 - DNA, 20 bp, Artificial Sequence
  gRNA target sequence
tgggtgagtcaatacttggg

SEQ ID NO: 4329 - DNA, 20 bp, Artificial Sequence
  gRNA target sequence
tgatgggtgagtcaatactt

SEQ ID NO: 4330 - DNA, 20 bp, Artificial Sequence
  gRNA target sequence
ttgatgggtgagtcaatact

SEQ ID NO: 4331 - DNA, 20 bp, Artificial Sequence
  gRNA target sequence
aatacatagcggttgttgat

SEQ ID NO: 4332 - DNA, 20 bp, Artificial Sequence
  gRNA target sequence
aaatacatagcggttgttga

SEQ ID NO: 4333 - DNA, 20 bp, Artificial Sequence
  gRNA target sequence
gtaatgtacgaaatacatag

SEQ ID NO: 4334 - DNA, 20 bp, Artificial Sequence
  gRNA target sequence
cgtacaatattcatggtggc

SEQ ID NO: 4335 - DNA, 20 bp, Artificial Sequence
  gRNA target sequence
gtaccgtacaatattcatgg

SEQ ID NO: 4336 - DNA, 20 bp, Artificial Sequence
  gRNA target sequence
atggtaccgtacaatattca

SEQ ID NO: 4337 - DNA, 20 bp, Artificial Sequence
  gRNA target sequence
tacaggtggtcaagtattta

SEQ ID NO: 4338 - DNA, 20 bp, Artificial Sequence
  gRNA target sequence
gggtttttatgtactacagg

SEQ ID NO: 4339 - DNA, 20 bp, Artificial Sequence
  gRNA target sequence
attgggtttttatgtactac

SEQ ID NO: 4340 - DNA, 20 bp, Artificial Sequence
  gRNA target sequence
agggggttttgatgtggatt

SEQ ID NO: 4341 - DNA, 20 bp, Artificial Sequence
  gRNA target sequence
gagggggttttgatgtggat

SEQ ID NO: 4342 - DNA, 20 bp, Artificial Sequence
  gRNA target sequence
atggggagggggttttgatg

SEQ ID NO: 4343 - DNA, 20 bp, Artificial Sequence
  gRNA target sequence
tgcttgtaagcatggggagg

SEQ ID NO: 4344 - DNA, 20 bp, Artificial Sequence
  gRNA target sequence
ttgcttgtaagcatggggag

SEQ ID NO: 4345 - DNA, 20 bp, Artificial Sequence
  gRNA target sequence
cttgcttgtaagcatgggga

SEQ ID NO: 4346 - DNA, 20 bp, Artificial Sequence
  gRNA target sequence
acttgcttgtaagcatgggg

SEQ ID NO: 4347 - DNA, 20 bp, Artificial Sequence
  gRNA target sequence
tgtacttgcttgtaagcatg

SEQ ID NO: 4348 - DNA, 20 bp, Artificial Sequence
  gRNA target sequence
ctgtacttgcttgtaagcat

SEQ ID NO: 4349 - DNA, 20 bp, Artificial Sequence
  gRNA target sequence
gctgtacttgcttgtaagca

SEQ ID NO: 4350 - DNA, 20 bp, Artificial Sequence
  gRNA target sequence
agttgatgtgtgatagttga

SEQ ID NO: 4351 - DNA, 20 bp, Artificial Sequence
  gRNA target sequence
cagttgatgtgtgatagttg

SEQ ID NO: 4352 - DNA, 20 bp, Artificial Sequence
  gRNA target sequence
tagtgggtgaggggtggctt

SEQ ID NO: 4353 - DNA, 20 bp, Artificial Sequence
  gRNA target sequence
gtatcctagtgggtgagggg

SEQ ID NO: 4354 - DNA, 20 bp, Artificial Sequence
  gRNA target sequence
ttggtatcctagtgggtgag

SEQ ID NO: 4355 - DNA, 20 bp, Artificial Sequence
  gRNA target sequence
gttggtatcctagtgggtga

SEQ ID NO: 4356 - DNA, 20 bp, Artificial Sequence
  gRNA target sequence
tgttggtatcctagtgggtg

SEQ ID NO: 4357 - DNA, 20 bp, Artificial Sequence
  gRNA target sequence
aggtttgttggtatcctagt

SEQ ID NO: 4358 - DNA, 20 bp, Artificial Sequence
  gRNA target sequence
taggtttgttggtatcctag

SEQ ID NO: 4359 - DNA, 20 bp, Artificial Sequence
  gRNA target sequence
ttaagggtgggtaggtttgt

SEQ ID NO: 4360 - DNA, 20 bp, Artificial Sequence
  gRNA target sequence
atgtactgttaagggtgggt

SEQ ID NO: 4361 - DNA, 20 bp, Artificial Sequence
  gRNA target sequence
tactatgtactgttaagggt

SEQ ID NO: 4362 - DNA, 20 bp, Artificial Sequence
  gRNA target sequence
gtactatgtactgttaaggg

SEQ ID NO: 4363 - DNA, 20 bp, Artificial Sequence
  gRNA target sequence
tatgtactatgtactgttaa

SEQ ID NO: 4364 - DNA, 20 bp, Artificial Sequence
  gRNA target sequence
ttatgtactatgtactgtta

SEQ ID NO: 4365 - DNA, 20 bp, Artificial Sequence
  gRNA target sequence
aatgtgctatgtacggtaaa

SEQ ID NO: 4366 - DNA, 20 bp, Artificial Sequence
  gRNA target sequence
tgactgtaatgtgctatgta

SEQ ID NO: 4367 - DNA, 20 bp, Artificial Sequence
  gRNA target sequence
gtcatccatggggacgagaa

SEQ ID NO: 4368 - DNA, 20 bp, Artificial Sequence
  gRNA target sequence
ggtcatccatggggacgaga

SEQ ID NO: 4369 - DNA, 20 bp, Artificial Sequence
  gRNA target sequence
tctgaggggggtcatccatg

SEQ ID NO: 4370 - DNA, 20 bp, Artificial Sequence
  gRNA target sequence
atctgaggggggtcatccat

SEQ ID NO: 4371 - DNA, 20 bp, Artificial Sequence
  gRNA target sequence
tatctgaggggggtcatcca

SEQ ID NO: 4372 - DNA, 20 bp, Artificial Sequence
  gRNA target sequence
aagggacccctatctgaggg

SEQ ID NO: 4373 - DNA, 20 bp, Artificial Sequence
  gRNA target sequence
caagggacccctatctgagg

SEQ ID NO: 4374 - DNA, 20 bp, Artificial Sequence
  gRNA target sequence
tcaagggacccctatctgag

SEQ ID NO: 4375 - DNA, 20 bp, Artificial Sequence
  gRNA target sequence
gtcaagggacccctatctga

SEQ ID NO: 4376 - DNA, 20 bp, Artificial Sequence
  gRNA target sequence
ggtcaagggacccctatctg

SEQ ID NO: 4377 - DNA, 20 bp, Artificial Sequence
  gRNA target sequence
tcacggaggatggtggtcaa

SEQ ID NO: 4378 - DNA, 20 bp, Artificial Sequence
  gRNA target sequence
ttcacggaggatggtggtca

SEQ ID NO: 4379 - DNA, 20 bp, Artificial Sequence
  gRNA target sequence
attgatttcacggaggatgg

SEQ ID NO: 4380 - DNA, 20 bp, Artificial Sequence
  gRNA target sequence
gatattgatttcacggagga

SEQ ID NO: 4381 - DNA, 20 bp, Artificial Sequence
  gRNA target sequence
gcgggatattgatttcacgg

SEQ ID NO: 4382 - DNA, 20 bp, Artificial Sequence
  gRNA target sequence
tgtgcgggatattgatttca

SEQ ID NO: 4383 - DNA, 20 bp, Artificial Sequence
  gRNA target sequence
ggagagtagcactcttgtgc

SEQ ID NO: 4384 - DNA, 20 bp, Artificial Sequence
  gRNA target sequence
aggagagtagcactcttgtg

SEQ ID NO: 4385 - DNA, 20 bp, Artificial Sequence
  gRNA target sequence
agtgttatgggcccggagcg

SEQ ID NO: 4386 - DNA, 20 bp, Artificial Sequence
  gRNA target sequence
acccccaagtgttatgggcc

SEQ ID NO: 4387 - DNA, 20 bp, Artificial Sequence
  gRNA target sequence
tagctacccccaagtgttat

SEQ ID NO: 4388 - DNA, 20 bp, Artificial Sequence
  gRNA target sequence
ttagctacccccaagtgtta

SEQ ID NO: 4389 - DNA, 20 bp, Artificial Sequence
  gRNA target sequence
ctgaagtaggaaccagatgt

SEQ ID NO: 4390 - DNA, 20 bp, Artificial Sequence
  gRNA target sequence
aggctttatgaccctgaagt

SEQ ID NO: 4391 - DNA, 20 bp, Artificial Sequence
  gRNA target sequence
ggggaacgtgtgggctattt

SEQ ID NO: 4392 - DNA, 20 bp, Artificial Sequence
  gRNA target sequence
cttatttaaggggaacgtgt

SEQ ID NO: 4393 - DNA, 20 bp, Artificial Sequence
  gRNA target sequence
tcttatttaaggggaacgtg

SEQ ID NO: 4394 - DNA, 20 bp, Artificial Sequence
  gRNA target sequence
atcgtgatgtcttatttaag

SEQ ID NO: 4395 - DNA, 20 bp, Artificial Sequence
  gRNA target sequence
catcgtgatgtcttatttaa

SEQ ID NO: 4396 - DNA, 20 bp, Artificial Sequence
  gRNA target sequence
ccatcgtgatgtcttattta

SEQ ID NO: 4397 - DNA, 29 bp, Artificial Sequence
  T7-1
  misc_feature (9)...(9): Phosphorothioate backbone linkage after position 9
  misc_feature (10)...(10): Phosphorothioate backbone linkage after position 10
  misc_feature (11)...(11): Phosphorothioate backbone linkage after position 11
gcctcgagctaatacgactcactatagag

SEQ ID NO: 4398 - DNA, 20 bp, Artificial Sequence
  T7-2
  misc_feature (0)...(0): 5' phosphate modification
ctctatagtgagtcgtatta

SEQ ID NO: 4399 - DNA, 45 bp, Artificial Sequence
  MlyI-1
  misc_feature (0)...(0): 5' phosphate modification
gggactcggatccctatagtgatacaaagacgatgacgacaagcg

SEQ ID NO: 4400 - DNA, 22 bp, Artificial Sequence
  MlyI-2
tcactatagggatccgagtccc

SEQ ID NO: 4401 - DNA, 94 bp, Artificial Sequence
  stlgR
  misc_feature (0)...(0): 5' phosphate modification
gttttagagctagaaatagcaagttaaaataaggctagtccgttatcaacttgaaaaagtggcaccgagtcggtgctttttttggatccgatgc

SEQ ID NO: 4402 - DNA, 89 bp, Artificial Sequence
  stlgRev
ggatccaaaaaaagcaccgactcggtgccactttttcaagttgataacggactagccttattttaacttgctatttctagctctaaaac

SEQ ID NO: 4403 - DNA, 21 bp, Artificial Sequence
  gRU
aaaaaaagcaccgactcggtg

SEQ ID NO: 4404 - DNA, 47 bp, Artificial Sequence
  MlyI-1
  misc_feature (0)...(0): 5' phosphate modification
gggggactcggatccctatagtgatacaaagacgatgacgacaagcg

SEQ ID NO: 4405 - DNA, 40 bp, Artificial Sequence
  T7-7
  misc_feature (9)...(9): Phosphorothioate backbone linkage after position 9
  misc_feature (10)...(10): Phosphorothioate backbone linkage after position 10
  misc_feature (11)...(11): Phosphorothioate backbone linkage after position 11
gcctcgagctaatacgactcactatagggatccaagtccc

SEQ ID NO: 4406 - DNA, 29 bp, Artificial Sequence
  T7-17
  misc_feature (9)...(9): Phosphorothioate backbone linkage after position 9
  misc_feature (10)...(10): Phosphorothioate backbone linkage after position 10
  misc_feature (11)...(11): Phosphorothioate backbone linkage after position 11
gcctcgagctaatacgactcactataggg

SEQ ID NO: 4407 - DNA, 23 bp, Artificial Sequence
  Flag
cgcttgtcgtcatcgtctttgta

SEQ ID NO: 4408 - DNA, 39 bp, Artificial Sequence
  MlyI-Ad1
gagatcagcttctgcattgatgccagcagcccgagtcag

SEQ ID NO: 4409 - DNA, 42 bp, Artificial Sequence
  MlyI-Ad2
  misc_feature (0)...(0): 5' phosphate modification
ctgactcgggctgctgtacaaagacgatgacgacaagcgtta

SEQ ID NO: 4410 - DNA, 46 bp, Artificial Sequence
  BsMm-Ad1
gagatcagcttctgcattgatgcggagccgcagtacactatccaac

SEQ ID NO: 4411 - DNA, 46 bp, Artificial Sequence
  BsMm-Ad2
  misc_feature (0)...(0): 5' phosphate modification
gttggatagtgtactgcggctcctacaaagacgatgacgacaagcg

SEQ ID NO: 4412 - DNA, 31 bp, Artificial Sequence
  T7-Ad1
  variation (30)...(31): n = A, T, C, or G
gcctcgagctaatacgactcactatagagnn

SEQ ID NO: 4413 - DNA, 79 bp, Artificial Sequence
  gR-top
  misc_feature (0)...(0): 5' phosphate modification
ttagagctagaaatagcaagttaaaataaggctagtccgttatcaacttgaaaaagtggcaccgagtcggtgctttttt

SEQ ID NO: 4414 - DNA, 82 bp, Artificial Sequence
  gR-bot
aaaaaagcaccgactcggtgccactttttcaagttgataacggactagccttattttaacttgctatttctagctctaaaac

SEQ ID NO: 4415 - DNA, 64 bp, Artificial Sequence
  BE Ad1
  misc_feature (0)...(0): 5' phosphate modification
actgctgacacaagtatcttttttttttgtttaaacttttttttttgatacacaagtcagcaga

SEQ ID NO: 4416 - DNA, 64 bp, Artificial Sequence
  BE Ad2
  misc_feature (0)...(0): 5' phosphate modification
tctgctgacttgtgtatcaaaaaaaaaagtttaaacaaaaaaaaaagatacttgtgtcagcagt

SEQ ID NO: 4417 - DNA, 22 bp, Artificial Sequence
  T7-Ad4
  misc_feature (0)...(0): 5' phosphate modification
  variation (1)...(2): n= A,T, C, or G
nnctctatagtgagtcgtatta

SEQ ID NO: 4418 - DNA, 79 bp, Artificial Sequence; identical to SEQ ID NO: 4413
  stlgR
  misc_feature (0)...(0): 5' adenylation

SEQ ID NO: 4419 - DNA, 20 bp, Artificial Sequence
  gRU
aaaaaagcaccgactcggtg

SEQ ID NO: 4420 - DNA, 37 bp, Artificial Sequence
  T7-RND8
  variation (29)...(37): n= A,T, C, or G
gcctcgagctaatacgactcactatagagnnnnnnnn

SEQ ID NO: 4421 - DNA, 21 bp, Artificial Sequence
  3' Adapter sequence
gggactcggatccctatagtc

SEQ ID NO: 4422 - DNA, 47 bp, Artificial Sequence
  Adapter Oligo
  modified_base (1)...(1): I
nttttagcggccgcctgctgctctacaaagacgatgacgacaagcgt

SEQ ID NO: 4423 - DNA, 45 bp, Artificial Sequence
  Adapter Oligo
gagatcagcttctgcattgatgcgagcagcaggcggccgctaaaa

SEQ ID NO: 4424 - DNA, 53 bp, Artificial Sequence
  Adapter Oligo
atttcgcggccgcttttattctgctgctctacaaagacgatgacgacaagcgt

SEQ ID NO: 4425 - DNA, 49 bp, Artificial Sequence
  Adapter Oligo
gagatcagcttctgcattgatgcgagcagcagaataaaagcggccgcga

SEQ ID NO: 4426 - DNA, 48 bp, Artificial Sequence
  Adapter Oligo
gcggccgcttttattctgctgctctacaaagacgatgacgacaagcgt

SEQ ID NO: 4427 - DNA, 49 bp, Artificial Sequence
  Adapter Oligo
  modified_base (48)...(48): I
gagatcagcttctgcattgatgcgagcagcagaataaaagcggccgcng

SEQ ID NO: 4428 - DNA, 50 bp, Artificial Sequence
  3' Adapter sequence
tcgcggccgcttttattctgctgctctacaaagacgatgacgacaagcgt

SEQ ID NO: 4429 - DNA, 50 bp, Artificial Sequence
  3' Adapter sequence
ttgcggccgcttttattctgctgctctacaaagacgatgacgacaagcgt

SEQ ID NO: 4430 - DNA, 45 bp, Artificial Sequence
  3' Adapter sequence
tttagcggccgcctgctgctctacaaagacgatgacgacaagcgt

The invention claimed is:

1. A method of making a collection of nucleic acids for a nucleic acid-guided nuclease system protein comprising at least $10^5$ unique guide nucleic acids (gNAs), each comprising a DNA comprising a targeting sequence ligated to a DNA comprising a nucleic acid-guided nuclease system protein-binding sequence, comprising:
   a. providing a plurality of double-stranded DNA molecules comprising at least $10^5$ unique sequences of interest, each comprising a sequence of interest 5' to a PAM sequence, and its reverse complementary sequence on the opposite strand, wherein the sequence of interest or its reverse complementary sequence corresponds to a targeting sequence;
   b. performing an enzymatic digestion reaction on the plurality of double stranded DNA molecules, wherein cleavages are generated at the PAM sequence and/or its reverse complementary sequence on the opposite strand, but without completely removing the PAM sequence and/or its reverse complementary sequence on the opposite strand from the double stranded DNA;
   c. ligating adapters comprising a recognition sequence to a plurality of the resulting DNA molecules of step (b);
   d. contacting the DNA molecules of step (c) with a restriction enzyme that recognizes the recognition sequence of step (c), whereby generating DNA fragments comprising blunt-ended double strand breaks immediately 5' to the PAM sequence, whereby removing the PAM sequence and the adapter containing the enzyme recognition site; and
   e. ligating the resulting double stranded DNA fragments of step (d) with a DNA comprising a nucleic acid-guided nuclease system protein-binding sequence, whereby generating a plurality of DNA fragments, each comprising a DNA comprising a targeting sequence ligated to a DNA comprising a nucleic acid-guided nuclease system protein-binding sequence, wherein the plurality of DNA fragments comprises at least $10^5$ unique targeting sequences.

2. The method of claim 1, wherein the nucleic acid-guided nuclease system protein is a CRISPR/Cas system protein.

3. The method of claim 1, wherein the double stranded DNA molecules further comprise a regulatory sequence upstream of the sequence of interest 5' to the PAM sequence.

4. The method of claim 3, wherein the regulatory sequence comprises a promoter.

5. The method of claim 4, wherein the promoter comprises a T7, Sp6, or T3 sequence.

6. The method of claim 1, wherein the double stranded DNA molecules are genomic DNA, intact DNA, or sheared DNA.

7. The method of claim 6, wherein the genomic DNA is human, mouse, avian, fish, plant, insect, bacterial, or viral.

8. The method of claim 1, wherein the DNA segments comprising a targeting sequence are at least 22 bp.

9. The method of claim 1, wherein the DNA segments comprising a targeting sequence are 15-250 bp in size range.

10. The method of claim 1, wherein the PAM sequence is AGG, CGG, or TGG.

11. The method of claim 1, wherein the PAM sequence is specific for a CRISPR/Cas system protein selected from the group consisting of Cas9, Cpf1, Cas3, Cas8a-c, Cas10, Cse1, Csy1, Csn2, Cas4, Csm2, and Cm5.

12. The method of claim 1, wherein step (b) further comprises (1) contacting the double stranded DNA molecules with an enzyme capable of creating a nick in a single strand at a CCD site, whereby generating a plurality of nicked double stranded DNA molecules, each comprising a sequence of interest followed by an HGG sequence, wherein the double stranded DNA molecules are nicked at the CCD sites; and (2) contacting the nicked double stranded DNA molecules with an endonuclease, whereby generating a plurality of double stranded DNA fragments, each comprising a sequence of interest followed by an HGG sequence wherein residual nucleotides from HGG and/or CCD sequences is (are) left behind.

13. The method of claim 1, wherein step (d) further comprises PCR amplification of the adaptor-ligated DNA fragments from step (c) before cutting with the restriction enzyme recognizing the recognition sequence of step (c), wherein after PCR, the recognition sequence is positioned 3' of the PAM sequence, and a regulatory sequence is positioned at the 5' distal end of the PAM sequence.

14. The method of claim 1, wherein the enzymatic digestion reaction comprises a first and a second nicking enzyme.

15. The method of claim 1, wherein step (c) further comprises a blunt-end reaction with a T4 DNA Polymerase, if the adapter to be ligated does not comprise an overhang.

16. The method of claim 1, wherein the adapter of step (c) is either (1) double stranded, comprising a restriction enzyme recognition sequence in one strand, and a regulatory sequence in the other strand, if the adapter is Y-shaped and comprises an overhang; or (2) has a palindromic enzyme recognition sequence in both strands, if the adapter is not Y-shaped.

17. The method of claim 1, wherein the restriction enzyme of step (d) is MlyI.

18. The method of claim 1, wherein step (d) further comprises contacting the DNA molecules with an XhoI enzyme.

19. The method of claim 1, wherein in step (e) the DNA comprising a nucleic acid-guided nuclease system protein-binding sequence encodes for a RNA comprising the sequence (SEQ ID NO: 1)
GUUUUAGAGCUAGAAAUAGCAAGUUAAAAUAAGGCUAGUCCGUUAUCAA

CUUGAAAAAGUGGCACCGAGUCGGUGCUUUUUUU or encodes for a RNA comprising the sequence (SEQ ID NO: 2)
GUUUUAGAGCUAUGCUGGAAACAGCAUAGCAAGUUAAAAUAAGGCUAGU

CCGUUAUCAACUUGAAAAAGUGGCACCGAGUCGGUGCUUUUUUUC.

20. The method of claim 1, wherein the sequences of interest are from an organism, and wherein the sequences of interest are spaced every 10,000 bp or less across the genome of the organism.

21. The method of claim 14, wherein the first nicking enzyme is a Nt.CviPII enzyme, and the second nicking enzyme is a T7 Endonuclease I enzyme.

* * * * *